(12) United States Patent
Turcotte et al.

(10) Patent No.: US 12,576,115 B2
(45) Date of Patent: ***Mar. 17, 2026

(54) BACTERIAL COMPOSITIONS FOR TREATING AND PREVENTING HALITOSIS

(71) Applicant: Imvela Corp., Brooklyn, NY (US)

(72) Inventors: Raphaël Turcotte, Brooklyn, NY (US); Ravi Sheth, Brooklyn, NY (US)

(73) Assignee: Imvela Corp., Brooklyn, NY (US)

( * ) Notice: Subject to any disclaimer, the term of this patent is extended or adjusted under 35 U.S.C. 154(b) by 0 days.

This patent is subject to a terminal disclaimer.

(21) Appl. No.: 18/884,680

(22) Filed: Sep. 13, 2024

(65) Prior Publication Data

US 2025/0082698 A1     Mar. 13, 2025

Related U.S. Application Data

(60) Provisional application No. 63/582,488, filed on Sep. 13, 2023.

(51) Int. Cl.
| | |
|---|---|
| *A23L 33/10* | (2016.01) |
| *A61K 9/14* | (2006.01) |
| *A61K 35/744* | (2015.01) |
| *A61K 35/00* | (2006.01) |

(52) U.S. Cl.
CPC .............. *A61K 35/744* (2013.01); *A61K 9/14* (2013.01); *A61K 2035/115* (2013.01)

(58) Field of Classification Search
None
See application file for complete search history.

(56) References Cited

U.S. PATENT DOCUMENTS

| | | | |
|---|---|---|---|
| 7,250,162 | B2 | 7/2007 | Oh |
| 7,595,041 | B2 | 9/2009 | Tagg et al. |
| 7,759,105 | B2 | 7/2010 | Cobb et al. |
| 9,192,634 | B2 | 11/2015 | Castellana |
| 2015/0201634 | A1 | 7/2015 | Fremaux et al. |
| 2020/0164002 | A1 | 5/2020 | Toledo et al. |
| 2022/0183326 | A1 | 6/2022 | Sheth et al. |
| 2023/0210917 | A1 | 7/2023 | Toledo et al. |
| 2023/0381093 | A1 | 11/2023 | Lee et al. |

(Continued)

FOREIGN PATENT DOCUMENTS

| | | |
|---|---|---|
| CN | 102000015 A | 4/2011 |
| CN | 106361683 A | 2/2017 |
| CN | 111956664 A | 11/2020 |

(Continued)

OTHER PUBLICATIONS

CP028254 GenBank: CP028254.1, Pediococcus pentosaceus strain SRCM102734 chromosome, complete genome, Jan. 27, 2020 (Year: 2020).*

(Continued)

*Primary Examiner* — Thane Underdahl
*Assistant Examiner* — Mary A Crum
(74) *Attorney, Agent, or Firm* — Wolf, Greenfield & Sacks, P.C.

(57) ABSTRACT
Some aspects of the disclosure relate to compositions comprising bacterial strains capable of reducing volatile sulfur compounds (VSCs) in an environment, nutritional supplements containing such bacterial strains, and methods of production and use thereof.

18 Claims, 3 Drawing Sheets

Specification includes a Sequence Listing.

(56) References Cited

U.S. PATENT DOCUMENTS

| | | |
|---|---|---|
| 2025/0234900 A1 | 7/2025 | Turcotte et al. |
| 2025/0235397 A1 | 7/2025 | Turcotte et al. |

FOREIGN PATENT DOCUMENTS

| | | | |
|---|---|---|---|
| CN | 115960740 A | 4/2023 | |
| DE | 202009011379 U1 | 12/2010 | |
| WO | WO 2005/007178 A1 | 1/2005 | |
| WO | WO 2006/022471 A1 | 3/2006 | |
| WO | WO 2009/026306 A2 | 2/2009 | |
| WO | WO 2009/026306 A3 | 4/2009 | |
| WO | WO 2012/022773 A1 | 2/2012 | |
| WO | WO 2018/065324 A1 | 4/2018 | |
| WO | WO 2018/071372 A1 | 4/2018 | |
| WO | WO 2019/118984 A2 | 6/2019 | |
| WO | WO 2021/144172 A1 | 7/2021 | |
| WO | WO 2022/061474 A1 | 3/2022 | |
| WO | WO 2022/090474 A1 | 5/2022 | |
| WO | WO 2022/238489 A1 | 11/2022 | |
| WO | WO 2023/011828 A1 | 2/2023 | |

OTHER PUBLICATIONS

MN453586 GenBank: MN453586.1, *Lactobacillus* sp. strain KCCP11226 16S ribosomal RNA gene, partial sequence, Sep. 16, 2019 (Year: 2019).*

CP035031 GenBank: CP035031, Lactiplantibacillus plantarum strain YW11 chromosome, complete genome, Jan. 17, 2019 (Year: 2019).*

Tsai, Cheng-Chih, et al. "Safety evaluation of multiple strains of Lactobacillus plantarum and Pediococcus pentosaceus in wistar rats based on the Ames test and a 28-day feeding study." The Scientific World Journal 2014.1 (2014): 928652 (Year: 2014).*

Bomba, A., et al. "Improvement of the probiotic effect of micro-organisms by their combination with maltodextrins, fructo-oligosaccharides and polyunsaturated fatty acids." British journal of Nutrition 88.S1 (2002): S95-S99 (Year: 2002).*

Bojarczuk, Adrianna, et al. "Health benefits of resistant starch: A review of the literature." Journal of functional foods 93 (2022): 105094 (Year: 2022).*

Gawor, Jerzy Pawel, et al. "Influence of Dietary Supplementation with a Powder Containing AN ProDen™ (*Ascophyllum nodosum*) Algae on Dog Saliva Metabolome." Frontiers in Veterinary Science 8 (2021): 681951 (Year: 2021).*

Hillspet, Hill's science plan performance adult dog food with chicken, hillspet.com.cy/en-cy/dog-food/sp-canine-science-plan-adult-performance-chicken-dry, 2025 (Year: 2025).*

Axling, Ulrika, et al. "Green tea powder and Lactobacillus plantarum affect gut microbiota, lipid metabolism and inflammation in high-fat fed C57BL/6J mice." Nutrition & metabolism 9 (2012): 1-18 (Year: 2012).*

U.S. Appl. No. 18/790,185, filed Jul. 31, 2024, Pending.

International Search Report and Written Opinion mailed Nov. 20, 2024 for Application No. PCT/US2024/046600.

Bampidis et al., Assessment of the feed additive consisting of Lactiplantibacillus plantarum (formerly Lactobacillus plantarum) DSM 12836 for all animal species for the renewal of its authorisation (Lactosan GmbH & Co KG). EFSA Panel on Additives and Products or Substances used in Animal Feed (FEEDAP). EFSA J. Jun. 14, 2021;19(6):e06626. doi: 10.2903/j.efsa.2021.6626.

Bampidis et al., Assessment of the feed additive consisting of Pediococcus pentosaceus DSM 12834 for all animal species for the renewal of its authorisation (Lactosan GmbH & Co KG). EFSA Panel on Additives and Products or Substances used in Animal Feed (FEEDAP). EFSA J. Jul. 19, 2021;19(7):e06713. doi: 10.2903/j.efsa.2021.6713.

Bampidis et al., Assessment of the application for modification of the terms of the authorisation of the feed additive consisting of Bacillus subtilisDSM 32324, Bacillus subtilis DSM 32325 and Bacillus amyloliquefaciens DSM 25840 (GalliPro® Fit) for all poultry species for fattening and reared for laying/breeding (Chr. Hansen A/S). EFSA Panel on Additives and Products or Substances used in Animal Feed (FEEDAP). EFSA J. Aug. 14, 2023;21(8):e08179. doi: 10.2903/j.efsa.2023.8179.

Homayouni Rad et al., A comprehensive review of the application of probiotics and postbiotics in oral health. Front Cell Infect Microbiol. Mar. 8, 2023;13:1120995. doi: 10.3389/fcimb.2023.1120995.

Jiang et al., Pediococcus pentosaceus, a future additive or probiotic candidate. Microb Cell Fact. Feb. 16, 2021;20(1):45. doi: 10.1186/s12934-021-01537-y.

Karbalaei et al., Alleviation of halitosis by use of probiotics and their protective mechanisms in the oral cavity. New Microbes New Infect. Apr. 23, 2021;42:100887. doi: 10.1016/j.nmni.2021.100887.

Todorov et al., Beneficial features of pediococcus: from starter cultures and inhibitory activities to probiotic benefits. World J Microbiol Biotechnol. Nov. 8, 2022;39(1):4. doi: 10.1007/s11274-022-03419-w.

Yuksekdag et al., Assessment of potential probiotic- and starter properties of *Pediococcus* spp. isolated from Turkish-type fermented sausages (sucuk). J Microbiol Biotechnol. Jan. 2010;20(1):161-8. doi: 10.4014/jmb.0904.04019.

Adnan et al., Functional and Structural Characterization of Pediococcus pentosaceus-Derived Biosurfactant and Its Biomedical Potential against Bacterial Adhesion, Quorum Sensing, and Biofilm Formation. Antibiotics (Basel). Nov. 9, 2021;10(11):1371. doi: 10.3390/antibiotics10111371.

Berninger et al., Maintenance and assessment of cell viability in formulation of non-sporulating bacterial inoculants. Microb Biotechnol. Mar. 2018;11(2):277-301. doi: 10.1111/1751-7915.12880. Epub Dec. 4, 2017.

Konstantinidis K, Sequence-discrete species for prokaryotes and other microbes: A historical perspective and pending issues. mLife. Dec. 11, 2023;2(4):341-349. doi: 10.1002/mlf2.12088.

Kupletskaya et al., Viability of lyophilized microorganisms after 50-year storage. Microbiology. Dec. 2, 2011;80(6):850-853. doi: 10.1134/S0026261711060129.

Park et al., Assessing the Probiotic Effects of Pediococcus pentosaceus CACC616 in Weaned Piglets. Microorganisms. Nov. 30, 2023;11(12):2890. doi: 10.3390/microorganisms11122890.

Peiren et al., Improving survival and storage stability of bacteria recalcitrant to freeze-drying: a coordinated study by European culture collections. Appl Microbiol Biotechnol. Apr. 2015;99(8):3559-71. doi: 10.1007/s00253-015-6476-6. Epub Mar. 17, 2015.

Rodriguez-R et al., An ANI gap within bacterial species that advances the definitions of intra-species units. mBio. Jan. 16, 2024;15(1):e0269623. doi: 10.1128/mbio.02696-23. Epub Dec. 12, 2023.

Viver et al., Towards estimating the number of strains that make up a natural bacterial population. Nat Commun. Jan. 16, 2024;15(1):544. doi: 10.1038/s41467-023-44622-z.

Xie et al., Moisture Content of Bacterial Cells Determines Thermal Resistance of *Salmonella enterica* Serotype Enteritidis PT 30. Appl Environ Microbiol. Jan. 15, 2021;87(3):e02194-20. doi: 10.1128/AEM.02194-20.

[No Author Listed], Bacteriology Culture Guide. American Type Culture Collection (ATCC®) 2025. 28 pages.

Abramovič et al., Water adsorption isotherms of some maltodextrin samples. Acta Chem. Slov. May 27, 2002;49:835-844.

Adams et al., The principles of freeze-drying. Methods Mol Biol. 2015;1257:121-143. doi: 10.1007/978-1-4939-2193-5_4.

Beaman et al., Bacterial spore heat resistance correlated with water content, wet density, and protoplast/sporoplast volume ratio. J Bacteriol. May 1982;150(2):870-7. doi: 10.1128/jb.150.2.870-877.1982.

Bodzen et al., Design of a new lyoprotectant increasing freeze-dried Lactobacillus strain survival to long-term storage. BMC Biotechnol. Nov. 12, 2021;21(1):66. doi: 10.1186/s12896-021-00726-2.

Noufeu et al., Overview of Glycometabolism of Lactic Acid Bacteria During Freeze-Drying: Changes, Influencing Factors, and Application Strategies. Foods. Feb. 22, 2025;14(5):743. doi: 10.3390/foods14050743.

(56)         References Cited

OTHER PUBLICATIONS

Passot et al., Critical water activity and amorphous state for optimal preservation of lyophilised lactic acid bacteria. Food Chemistry, 2012, 132 (4), pp. 1699-1705. doi: 10.1016/j.foodchem.2011.06. 012. hal-01536691. Author Manuscript, 35 pages.

* cited by examiner

BACTERIAL COMPOSITIONS FOR TREATING AND PREVENTING HALITOSIS

RELATED APPLICATION

This application claims the benefit under 35 U.S.C. § 119(e) of U.S. Provisional Application No. 63/582,488, filed Sep. 13, 2023, the contents of which are incorporated by reference herein in their entirety.

REFERENCE TO AN ELECTRONIC SEQUENCE LISTING

The contents of the electronic sequence listing (I055870004US01-SEQ-NTJ.xml; Size: 62,137,398 bytes; and Date of Creation: Sep. 13, 2024) are herein incorporated by reference in their entirety.

BACKGROUND

Halitosis, commonly known as bad breath, is an oral health issue that affects several mammalian species, including humans and dogs. Halitosis is characterized by the buildup of compounds within the oral cavity, which emit a strong, offensive odor. The main malodorous compounds are volatile sulfur compounds (VSCs). These compounds are byproducts of bacterial metabolism. VSCs include hydrogen sulfide, methyl mercaptan, and dimethyl sulfide, all of which give off strong and unpleasant odors.

SUMMARY

Some aspects of the disclosure relate to compositions comprising *Pediococcus pentosaceus*. Some aspects relate to methods of using compositions comprising *Pediococcus pentosaceus*. Such compositions and methods are based, at least in part, on the recognition that *P. pentosaceus* is able to effectively decrease volatile sulfur compounds (VSCs), which are associated with halitosis. In dogs, halitosis is also associated with an increase in oral pH, which is hospitable to VSC-producing microbes and VSC production itself. *P. pentosaceus* is useful, in part, because it is capable of reducing VSC abundance in an alkaline environment, such as that typical of halitosis in dogs. While *P. pentosaceus* alone is useful for reduction of VSC abundance in an alkaline environment, compositions containing *P. pentosaceus* may also comprise additional bacterial strains or non-bacterial components useful in treating or preventing halitosis. For example, a composition may comprise one or more bacterial strains that produce organic acids, thereby acidifying the oral microenvironment (e.g., to a pH below 7.5), resulting in less favorable conditions for VSC production and/or growth of VSC producing microorganisms. A composition may comprise one or more bacterial strains that reduce the abundance of VSCs in neutral or acidic environment (e.g., having a pH below 7.5), further alleviating the unpleasant odors caused by the presence of VSCs in the oral microenvironment. A composition may comprise one or more bacterial strains that enhance the ability of another strain (e.g., *P. pentosaceus*) to reduce VSC abundance. Such enhancements may occur through any suitable method, such as enhancing the growth or metabolic activity of the VSC-reducing strain(s). A composition may further comprise one or more additional components, such as vitamins, organic acids, a polyphenols, indole-containing compounds, and phenols. In addition to the benefits of organic acids in reducing the oral microenvironment pH, thereby hindering VSC production and/or growth of VSC-producing microorganisms, such additional components enhance the VSC-reducing ability of bacterial strains present in a composition. For example, while *P. pentosaceus* alone reduced VSC levels, this VSC reduction was markedly improved in the presence of other *Lactobacillus* strains (FIG. 2B) or green tea polyphenols (FIG. 3).

Accordingly, some aspects relate to a nutritional supplement comprising a bacterial mixture and a carrier, the bacterial mixture comprising: (i) a first bacterial strain comprising a 16S rDNA sequence with at least 97% sequence identity to the nucleotide sequence of SEQ ID NO: 1; and (ii) one or more additional bacterial strains selected from the group consisting of: (a) a second bacterial strain comprising a 16S rDNA sequence with at least 97% sequence identity to the nucleotide sequence of SEQ ID NO: 2; and (b) a third bacterial strain that is different from the second bacterial strain and comprises a 16S rDNA sequence with at least 97% sequence identity to the nucleotide sequence of SEQ ID NO: 3, wherein each of the bacterial strains is in powder form. In some embodiments, the bacterial mixture comprises the second bacterial strain and the third bacterial strain, wherein: (1) the first bacterial strain reduces abundance of one or more volatile sulfur compounds (VSCs); (2) the second bacterial strain enhances the reduction in abundance of one or more VSCs by the first bacterial strain; and/or (3) the third bacterial strain reduces pH of an oral microenvironment of a subject to a value less than 7.5.

In some embodiments, the nutritional supplement comprises a fiber and/or a starch. In some embodiments, the nutritional supplement comprises maltodextrin. In some embodiments, the nutritional supplement comprises tapioca and/or a fiber selected from the group consisting of sugar beet pulp, chicory pulp, chicory, coconut endosperm fiber, wheat fiber, fructooligosaccharides, galactooligosaccharides, and inulin.

In some embodiments, the nutritional supplement is in the form of powder meal topper.

In some embodiments, each of the bacterial strains is lyophilized or spray-dried.

In some embodiments, the nutritional supplement comprises a dried algae. In some embodiments, the nutritional supplement comprises a dried algae selected from the group consisting of *Ascophyllum nodosum, Spirulina, Chlorella, Ulva lactuca, Laminaria digitata* and *Fucus vesiculosus*.

In some embodiments: the first bacterial strain comprises a 16S rDNA sequence with at least 99% sequence identity to the nucleotide sequence of SEQ ID NO: 1; the second bacterial strain comprises a 16S rDNA sequence with at least 99% sequence identity to the nucleotide sequence of SEQ ID NO: 2; and the third bacterial strain comprises a 16S rDNA sequence with at least 99% sequence identity to the nucleotide sequence of SEQ ID NO: 3.

In some embodiments, the nutritional supplement comprises an antioxidant selected from the group consisting of vitamin A, vitamin C, vitamin E, green tea polyphenol, tannins, resveratrol, flavonoids, anthrocyanins, indoleacrylic acid, indolepropionic acid, indole-3-carbinol, indoleacrylic acid, indolelactic acid, indoleacetic acid indolepyruvic acid, tryptophol, and Coenzyme Q10.

In some embodiments, the nutritional supplement comprises $1 \times 10^5$ to $1 \times 10^{10}$ colony forming units (CFUs) of each of the bacterial strains.

In some embodiments, the nutritional supplement treats or prevents one or more symptoms of halitosis in a subject. In some embodiments, the nutritional supplement reduces abundance of one or more VSCs in an oral cavity of a subject. In some embodiments, the nutritional supplement reduces abundance of one or more microorganisms that produce one or more VSCs in an oral cavity of a subject. In some embodiments, the nutritional supplement treats or prevents one or more symptoms of oral inflammation in a subject. In some embodiments, the nutritional supplement reduces abundance of or prevents formation of gingivitis, plaque, tartar, and/or dental calculus in a subject. In some embodiments, the subject is a dog or cat.

In some embodiments, the nutritional supplement, wherein the nutritional supplement comprises a grain selected from the group consisting of wheat, corn, rice, oats, and barley. In some embodiments, the nutritional supplement comprises a meat and/or animal-derived material.

Some aspects relate to a composition comprising a purified bacterial mixture, the purified bacterial mixture comprising: (i) a bacterial strain comprising a 16S rDNA sequence with at least 97% sequence identity to the nucleic acid sequence of SEQ ID NO: 1; and (ii) one or more additional bacterial strains.

In some embodiments, the one or more additional bacterial strains are capable of (a) reducing the pH of an environment from 7.5 or higher to less than 7.5; (b) reducing the abundance of one or more volatile sulfur compounds (VSCs) in an environment having a pH of less than 7.5; and/or (c) enhancing the reduction in abundance of one or more VSCs by the bacterial strain of (i).

In some embodiments, the one or more additional bacterial strains are selected from the group consisting of (i) a bacterial strain comprising a 16S rDNA sequence with at least 97% sequence identity to the nucleic acid sequence of SEQ ID NO: 2; (ii) a bacterial strain comprising a 16S rDNA sequence with at least 97% sequence identity to the nucleic acid sequence of SEQ ID NO: 3; (iii) a bacterial strain comprising a 16S rDNA sequence with at least 97% sequence identity to the nucleic acid sequence of SEQ ID NO: 4; (iv) a bacterial strain comprising a 16S rDNA sequence with at least 97% sequence identity to the nucleic acid sequence of SEQ ID NO: 5; (v) a bacterial strain comprising a 16S rDNA sequence with at least 97% sequence identity to the nucleic acid sequence of SEQ ID NO: 6; (vi) a bacterial strain comprising a 16S rDNA sequence with at least 97% sequence identity to the nucleic acid sequence of SEQ ID NO: 7; (vii) a bacterial strain comprising a 16S rDNA sequence with at least 97% sequence identity to the nucleic acid sequence of SEQ ID NO: 8; (viii) a bacterial strain comprising a 16S rDNA sequence with at least 97% sequence identity to the nucleic acid sequence of SEQ ID NO: 9; (ix) a bacterial strain comprising a 16S rDNA sequence with at least 97% sequence identity to the nucleic acid sequence of SEQ ID NO: 10; (x) a bacterial strain comprising a 16S rDNA sequence with at least 97% sequence identity to the nucleic acid sequence of SEQ ID NO: 11; (xi) a bacterial strain comprising a 16S rDNA sequence with at least 97% sequence identity to the nucleic acid sequence of SEQ ID NO: 12; (xii) a bacterial strain comprising a 16S rDNA sequence with at least 97% sequence identity to the nucleic acid sequence of SEQ ID NO: 13; (xiii) a bacterial strain comprising a 16S rDNA sequence with at least 97% sequence identity to the nucleic acid sequence of SEQ ID NO: 14; (xiv) a bacterial strain comprising a 16S rDNA sequence with at least 97% sequence identity to the nucleic acid sequence of SEQ ID NO: 15; (xv) a bacterial strain comprising a 16S rDNA sequence with at least 97% sequence identity to the nucleic acid sequence of SEQ ID NO: 16; and (xvi) a bacterial strain comprising a 16S rDNA sequence with at least 97% sequence identity to the nucleic acid sequence of SEQ ID NO: 17. In some embodiments, the purified bacterial mixture comprises: a bacterial strain comprising a 16S rDNA sequence with at least 97% sequence identity to the nucleic acid sequence of SEQ ID NO: 1; and a bacterial strain comprising a 16S rDNA sequence with at least 97% sequence identity to the nucleic acid sequence of SEQ ID NO: 17.

In some embodiments, the purified bacterial mixture comprises: a bacterial strain comprising a 16S rDNA sequence with at least 97% sequence identity to the nucleic acid sequence of SEQ ID NO: 1; a bacterial strain comprising a 16S rDNA sequence with at least 97% sequence identity to the nucleic acid sequence of SEQ ID NO: 2; and a bacterial strain comprising a 16S rDNA sequence with at least 97% sequence identity to the nucleic acid sequence of SEQ ID NO: 3.

In some embodiments, the purified bacterial mixture further comprises *Shouchella clausii, Bacillus amyloliquefaciens, Bacillus licheniformis, Bacillus pumilus, Bacillus subtilis, Bifidobacterium adolescentis, Bifidobacterium animalis, Bifidobacterium bifidum, Bifidobacterium longum, Bifidobacterium longum* subsp. *infantis, Bifidobacterium thermophilum, Enterococcus faecium, Enterococcus lactis, Lacticaseibacillus casei, Lactiplantibacillus plantarum, Lactobacillus acidophilus, Lactobacillus delbrueckii, Lactobacillus helveticus, Lactococcus cremoris, Lactococcus lactis, Latilactobacillus curvatus, Lentilactobacillus buchneri, Leuconostoc mesenteroides, Levilactobacillus brevis, Ligilactobacillus animalis, Limosilactobacillus fermentum, Limosilactobacillus reuteri, Pediococcus acidilactici, Pediococcus damnosus, Pediococcus pentosaceus, Acidipropionibacterium acidipropionici, Propionibacterium freudenreichii, Propionibacterium freudenreichii* subsp. *shermanii, Streptococcus thermophilus, Streptococcus salivarius, Weizmannia coagulans*, and/or *Weissella cibaria*.

In some embodiments, the composition further comprises an antioxidant. In some embodiments, the antioxidant is selected from the group consisting of a vitamin, an organic acid, a polyphenol, an indole-containing compound, and a phenol.

Some aspects relate to a purified bacterial strain comprising a 16S rDNA sequence with at least 97% sequence identity to the nucleic acid sequence of SEQ ID NO: 1; and an antioxidant.

In some embodiments, the antioxidant is selected from the group consisting of a vitamin, an organic acid, a polyphenol, an indole-containing compound, and a phenol.

Some aspects relate to a composition comprising a purified bacterial mixture, the purified bacterial mixture comprising: a bacterial strain belonging to *Pediococcus pentosaceus*; and (ii) one or more additional bacterial strains.

In some embodiments, the one or more additional bacterial strains are capable of (a) reducing the pH of an environment from 7.5 or higher to less than 7.5; (b) reducing the abundance of one or more volatile sulfur compounds (VSCs) in an environment having a pH of less than 7.5; and/or (c) enhancing the reduction in abundance of one or more VSCs by the bacterial strain of (i).

In some embodiments, the purified bacterial mixture further comprises one or more bacterial strains selected from: (i) a first bacterial strain belonging to *Lactiplantibacillus plantarum*; (ii) a second bacterial strain belonging to *Lactiplantibacillus plantarum*, wherein the first and second bacterial strains belonging to *Lactiplantibacillus plantarum* are different bacterial strains; (iii) a bacterial strain belonging to *Latilactobacillus curvatus*; (iv) a bacterial strain belonging to *Limosilactobacillus fermentum*; (v) a bacterial strain belonging to *Leuconostoc mesenteroides*; (vi) a bacterial strain belonging to *Lactobacillus acidophilus*; (vii) a bacterial strain belonging to *Enterococcus faecium*; (viii) a bacterial strain belonging to *Bacillus subtilis*; (ix) a bacterial strain belonging to *Bacillus pumilus*; (x) a bacterial strain belonging to *Bacillus licheniformis*; (xi) a bacterial strain belonging to *Bacillus amyloliquefaciens*; (xii) a bacterial strain belonging to *Weizmannia coagulans*; (xiii) a bacterial strain belonging to *Weissella cibaria*; (xiv) a bacterial strain belonging to *Streptococcus salivarius*; (xv) a bacterial strain belonging to *Lactococcus lactis*; and (xvi) a second bacterial strain belonging to *Pediococcus pentosaceus*.

In some embodiments, the purified bacterial mixture further comprises *Shouchella clausii, Bacillus amyloliquefaciens, Bacillus licheniformis, Bacillus pumilus, Bacillus subtilis, Bifidobacterium adolescentis, Bifidobacterium animalis, Bifidobacterium bifidum, Bifidobacterium longum, Bifidobacterium longum* subsp. *infantis, Bifidobacterium thermophilum, Enterococcus faecium, Enterococcus lactis, Lacticaseibacillus casei, Lactiplantibacillus plantarum, Lactobacillus acidophilus, Lactobacillus delbrueckii, Lactobacillus helveticus, Lactococcus cremoris, Lactococcus lactis, Latilactobacillus curvatus, Lentilactobacillus buchneri, Leuconostoc mesenteroides, Levilactobacillus brevis, Ligilactobacillus animalis, Limosilactobacillus fermentum, Limosilactobacillus reuteri, Pediococcus acidilactici, Pediococcus damnosus, Pediococcus pentosaceus, Acidipropionibacterium acidipropionici, Propionibacterium freudenreichii, Propionibacterium freudenreichii* subsp. *shermanii, Streptococcus thermophilus, Streptococcus salivarius, Weizmannia coagulans,* and/or *Weissella cibaria.*

In some embodiments, the purified bacterial mixture comprises a first bacterial strain belonging to *Pediococcus pentosaceus*; and a second bacterial strain belonging to *Pediococcus pentosaceus*.

In some embodiments, the purified bacterial mixture comprises: a bacterial strain belonging to *Pediococcus pentosaceus*; a first bacterial strain belonging to *Lactiplantibacillus plantarum*; and a second bacterial strain belonging to *Lactiplantibacillus plantarum*.

In some embodiments, the composition further comprises an antioxidant. In some embodiments, the antioxidant is selected from the group consisting of a vitamin, an organic acid, a polyphenol, an indole-containing compound, and a phenol.

In some aspects, the disclosure relates to a composition comprising a purified bacterial strain belonging to *Pediococcus pentosaceus* and an antioxidant. In some embodiments, the antioxidant is selected from the group consisting of a vitamin, an organic acid, a polyphenol, an indole-containing compound, and a phenol.

Some aspects relate to a composition comprising a purified bacterial mixture, the purified bacterial mixture comprising: (a) a bacterial strain that reduces the abundance of one or more volatile sulfur compounds (VSCs) in an environment having a pH of 7.5 or higher; and one or more of: (b) a bacterial strain that reduces the pH of an environment from 7.5 or higher to less than 7.5; (c) a bacterial strain that reduces the abundance of one or more VSCs in an environment having a pH of less than 7.5; and (d) a bacterial strain that enhances the reduction in abundance of one or more VSCs by the bacterial strain of (a).

In some embodiments, the bacterial strain of (a) is *Pediococcus pentosaceus*. In some embodiments, the bacterial strain of (b) is *Pediococcus pentosaceus*, the bacterial strain of (c) is *Pediococcus pentosaceus*, and/or the bacterial strain of (d) is *Pediococcus pentosaceus*. In some embodiments, the *Pediococcus pentosaceus* comprises a 16S rDNA sequence with at least 97% sequence identity to SEQ ID NO: 1.

In some embodiments, the composition further comprises one or more additional bacterial strains. In some embodiments, the purified bacterial mixture further comprises 2, 3, 4, 5, 6, 7, 8, 9, 10, 11, 12, 13, 14, 15, 16, 17, 18, 19, or 20 bacterial strains. In some embodiments, the purified bacterial mixture comprises 2, 3, 4, 5, 6, 7, 8, 9, or 10 bacterial strains.

In some embodiments, the composition reduces the abundance of one or more volatile sulfur compounds (VSCs) in an environment having a pH of 7.5 or higher. In some embodiments, the composition reduces the abundance of one or more volatile sulfur compounds (VSCs) in an environment having a pH less than 7.5. In some embodiments, the composition reduces the abundance of one or more volatile sulfur compounds (VSCs) in an oral microenvironment of a subject. In some embodiments, the one or more VSCs are selected from the group consisting of hydrogen sulfide, methyl mercaptan, and dimethyl sulfide. In some embodiments, the composition treats or prevents one or more symptom of halitosis in a subject.

In some embodiments, the composition reduces the abundance of one or more volatile sulfur compound (VSC)-producing microorganisms in a subject. In some embodiments, the one or more VSC-producing microorganisms are selected from the group consisting of *Fusobacterium nucleatum, Prevotella intermedia, Porphyromonas caningivalis, Porphyromonas gingivalis, Tannerella forsythia,* and *Treponema denticola*.

In some embodiments, the bacterial strains are lyophilized. In some embodiments, the bacterial strains are spray-dried. In some embodiments, the composition is in a flowable powder form. In some embodiments, one or more of the bacterial strains is in spore form. In some embodiments, one or more of the bacterial strains is in vegetative form. In some embodiments, each of the bacterial strains is in vegetative form. In some embodiments, each of the bacterial strains is present in an amount from $10^5$ to $10^{13}$ colony forming units (CFUs) per gram of the composition. In some embodiments, each of the bacterial strains is present in an amount from $10^5$ to $10^{10}$ colony forming units (CFUs) per gram of the composition. In some embodiments, each of the bacterial strains is present in an amount from $10^6$ to $10^{10}$ colony forming units (CFUs) per gram of the composition.

In some embodiments, the composition further comprises an organic acid. In some embodiments, the organic acid is selected from the group consisting of lactic acid, ascorbic acid, acetic acid, acrylic acid, propionic acid, pyruvic acid, and citric acid.

In some embodiments, the composition further comprises an indole-containing compound. In some embodiments, the indole-containing compound is selected from the group consisting of indoleacrylic acid, indolepropionic acid, indoleacetic acid, indole-3-carbinol, indole-3-acetamine, indolealdehyde, indolelactic acid, indolepyruvate, tryptophol, and indole.

In some embodiments, the composition further comprises a vitamin. In some embodiments, the vitamin is selected from vitamin A, vitamin C, vitamin $B_1$, $B_2$, $B_6$, $B_{12}$, vitamin $D_3$, vitamin E, and vitamin K. In some embodiments, the composition further comprises a polyphenol. In some embodiments, the polyphenol is selected from the group consisting of green tea polyphenols, tannins, resveratrol, flavonoids, and anthrocyanins.

Some aspects relate to a nutritional supplement comprising a composition as described herein, and a carrier.

In some embodiments, each of the bacterial strains is present in an amount from $10^5$ to $10^{13}$ colony forming units (CFUs) per gram of the composition. In some embodiments, each of the bacterial strains is present in an amount from $10^5$ to $10^{10}$ colony forming units (CFUs) per gram of the composition. In some embodiments, each of the bacterial strains is present in an amount from $10^6$ to $10^{10}$ colony forming units (CFUs) per gram of the composition.

In some embodiments, the nutritional supplement is a canine nutritional supplement. In some embodiments, the nutritional supplement comprises a meat or animal-derived material. In some embodiments, the meat or animal-derived material is beef, chicken, eggs, turkey, lamb, fish, blood marrow, and/or bone marrow. In some embodiments, the nutritional supplement comprises a grain. In some embodiments, the grain is wheat, corn, rice, oats, and/or barley. In some embodiments, the nutritional supplement comprises a fiber. In some embodiments, the fiber is sugar beet pulp, chicory pulp, chicory, coconut endosperm fiber, wheat fiber, fructooligosaccharides, galactooligosaccharides, and/or inulin. In some embodiments, the nutritional supplement comprises algae. In some embodiments, the algae is *Ascophyllum nodosum, Spirulina*, and/or *Fucus vesiculosus.*

In some embodiments, the nutritional supplement comprises a gelatinized starch matrix. In some embodiments, the nutritional supplement reduces inflammation in a subject. In some embodiments, the nutritional supplement treats or prevents a symptom associated with halitosis in a subject.

Some aspects relate to a method comprising administering a composition or nutritional supplement as described herein to a subject. In some embodiments, the administration is oral administration. In some embodiments, the subject has halitosis. In some embodiments, an oral microenvironment of the subject has a pH of 7.5 or higher. In some embodiments, an oral microenvironment of the subject comprises one or more bacterial strains selected from *Porphyromonas gingivalis, Prevotella intermedia, Porphyromonas canigingivalis, Tannerella forsythia, Treponema denticola*, and *Fusobacterium nucleatum*. In some embodiments, administration of the composition (i) reduces the abundance of one or more VSCs in an oral microenvironment of the subject; (ii) reduces inflammation in the oral microenvironment of the subject; (iii) reduces the abundance of gingivitis, plaque, tartar, and/or dental calculus in the subject; (iv) reduces the abundance of one or more bacterial strains associated with the production of VSCs; (v) reduces one or more symptom associated with halitosis; and/or (vi) improves oral health of the subject. In some embodiments, the subject is a carnivore. In some embodiments, the subject is a mammal. In some embodiments, the subject is a domesticated animal. In some embodiments, the subject is a bovine, swine, llama, alpaca, sheep, or goat. In some embodiments, the subject is a dog, cat, rabbit, guinea pig, hamster, or ferret. In some embodiments, the subject is a dog.

BRIEF DESCRIPTION OF THE DRAWINGS

The accompanying drawings, which constitute a part of this specification, illustrate several embodiments of the disclosure and together with the description, serve to explain the principles of the disclosure.

*ceus*), which was markedly better than control strains (Species 1, 2, or 3). Dashed line indicates average VSC levels of negative control groups. a.u.=arbitrary units.

Figure 2A:
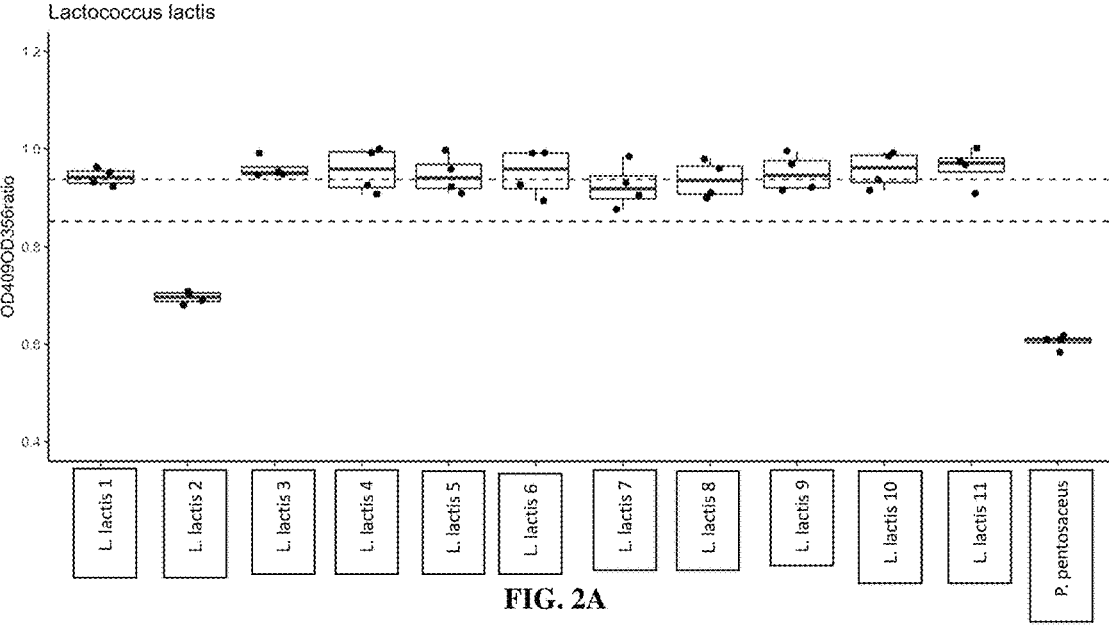
Figure 2B:
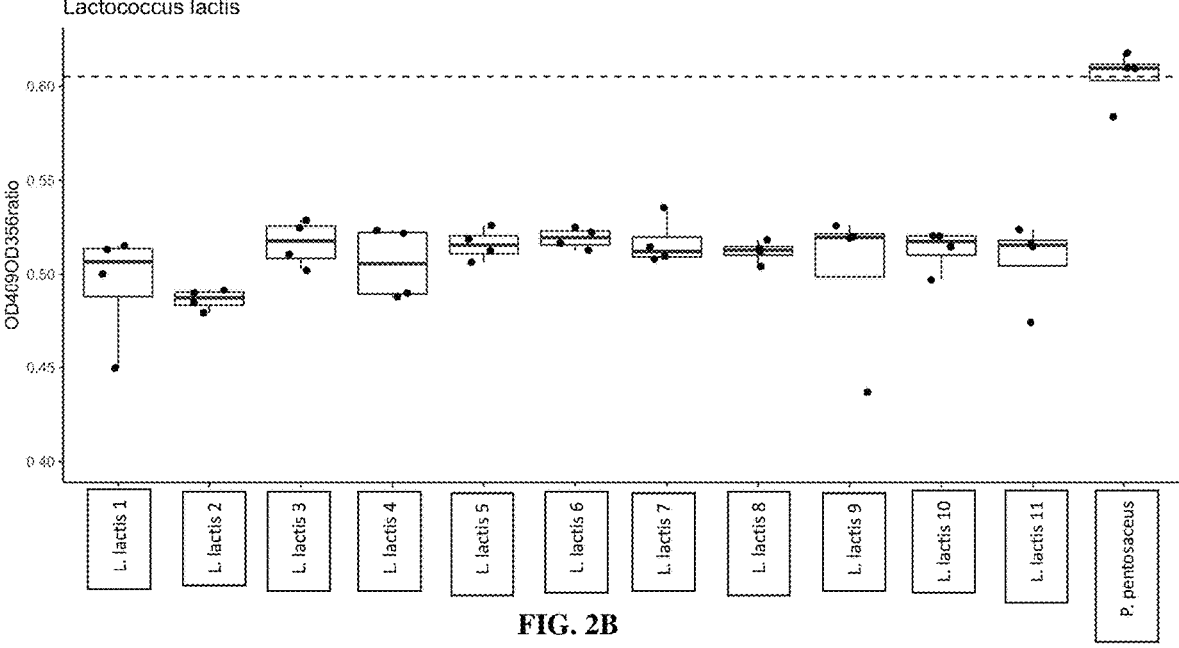

FIGS. 2A and 2B show effects of *Lactococcus* strains on VSC levels alone (FIG. 2A) or in combination with *Pediococcus pentosaceus* (FIG. 2B). 11 leftmost groups represent distinct *Lactococcus lactis* strains, and rightmost group (ZAP3J4) represents *Pediococcus pentosaceus* alone.

Figure 3:
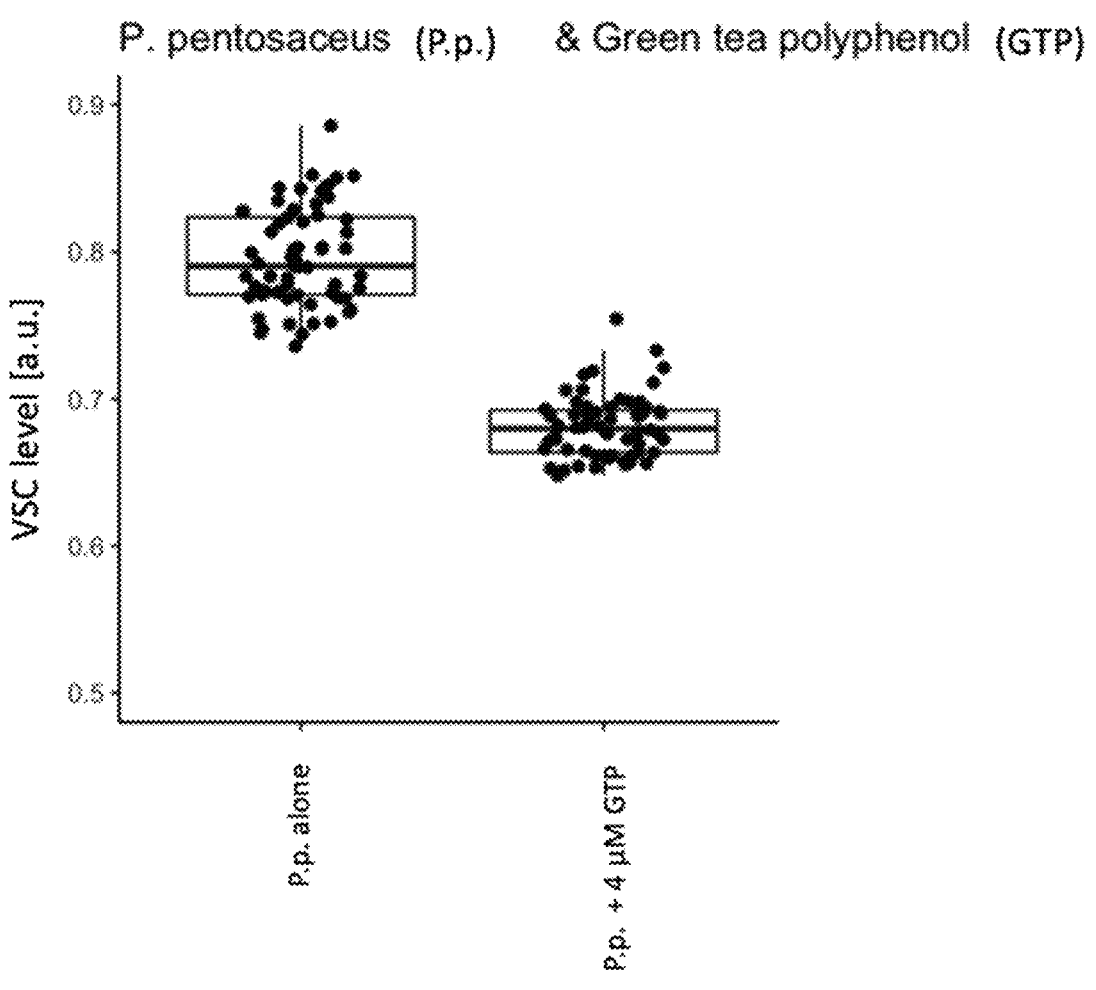

FIG. 3 shows reduction in VSC abundance by *Pediococcus pentosaceus* alone (left; P.p. alone) or in combination with green tea polyphenol (GTP) (right; P.p.+4 μM GTP). a.u.=arbitrary units.

DETAILED DESCRIPTION

Aspects of the present disclosure relate to compositions and nutritional supplements comprising microbial mixtures including one or more bacterial strains that reduce levels of volatile sulfur compounds (VSCs) in an environment and/or inhibit VSC production by other microorganisms, and methods of use and production thereof. Without wishing to be bound by theory, the compositions described herein comprising *Pediococcus pentosaceus* are useful for reducing VSC abundance in an alkaline oral environment, which is associated with halitosis. Other bacterial strains may further enhance the VSC-reducing capacity of *Pediococcus pentosaceus*, reduce the pH of an oral microenvironment, and/or reduce VSC abundance in a neutral or acidic environment, thereby further alleviating halitosis. Similarly, other non-bacterial components (e.g., antioxidants, polyphenols) may further enhance the beneficial effects of *Pediococcus pentosaceus* and, in some embodiments, optional bacterial strains.

Figure 1:
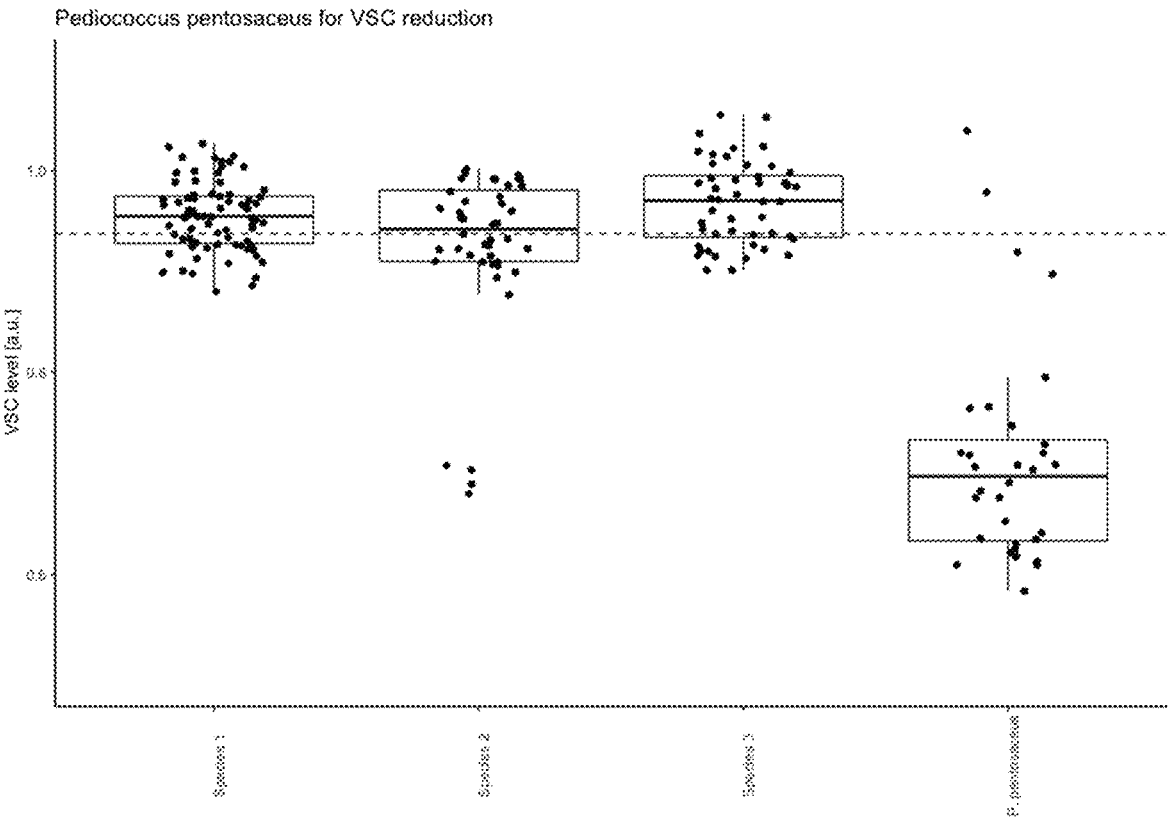
FIG. 1 shows reduction in volatile sulfur compound (VSC) abundance by *Pediococcus pentosaceus* (*P. pentosa-*

Consumption of beneficial microorganisms, namely bacteria, has been practiced for centuries due to the prevalence of fermented foods and beverages, e.g., yogurt, kimchi, beer. The consumed microorganisms can colonize or engraft anatomical niches (e.g., skin, gastrointestinal tract, lungs) of the host and propagate. Currently, purposeful colonization with beneficial microbes is being pursued as a clinical tool in human health as evident by the recent U.S. Food and Drug Administration (FDA) approval of a fecal microbial transplant. Temporally, this research dovetails with the desire of humans to improve the quality of life of their companion animals, namely dogs and cats. Currently, significant challenges for a canine-focused probiotic with validated immunoregulatory function include the rational design of the microbial community and successful delivery of the product to the canine subject. Canonically, most canine probiotics are formulated with bacterial strains belonging to the genera *Lactobacillus, Bifidobacterium*, and *Enterococcus*. The inclusion of these microbes is based on non-specific qualifications of these microbes as traditional, safe, beneficial microbes. For canine supplements intended to ameliorate symptoms related to halitosis (e.g., bad breath and gingivitis), microorganisms capable of reducing the concentration of VSCs in the oral environment and/or alleviating inflammation are respectively required. Moreso, products (e.g., nutritional supplements) containing these microbes should be formulated such that the desired phenotype (e.g., reduction of VSCs) can be carried out at the intended anatomical site (e.g., the canine oral environment). Unlike previous uses of bacteria in alleviating disease, compositions comprising *Pediococcus pentosaceus* are able to effectively reduce VSC abundance (FIG. 1), inhibit VSC production by other microorganisms, and reduce the pH of the oral microenvironment, which tends to be more alkaline (pH>7.5) in subjects with halitosis. Furthermore, the combination of *Pediococcus pentosaceus* with other bacterial strains (e.g., *Lactobacillus*) and/or non-bacterial components (e.g., polyphenols) further enhances the VSC-reducing ability of a composition (FIGS. 2A-3).

Compositions comprising bacteria may be in any suitable form, such as a dry, flowable powder, which is not hygroscopic, but rather pourable, allowing for easier combination with other compositions (e.g., combination with food prior to a meal). Compositions comprising bacteria may also be present as part of another composition, such as a pill, capsule, tablet, chewable matrix, nutritional supplement, dental supplement, or food product.

This disclosure is not limited in its application to the details of construction and the arrangement of components set forth in the following description or illustrated in the drawings. The disclosure is capable of other embodiments and of being practiced or of being carried out in various ways. Also, the phraseology and terminology used herein is for the purpose of description and should not be regarded as limiting. The use of "including," "comprising," or "having," "containing," "involving," and variations thereof herein, is meant to encompass the items listed thereafter and equivalents thereof as well as additional items.

Bacterial Strains

Some aspects relate to compositions nutritional supplements, dental supplements, and/or food products comprising a bacterial strain comprising a 16S rDNA sequence with at least 97% sequence identity to the nucleic acid sequence of SEQ ID NO: 1 or SEQ ID NO: 17. Some aspects relate to compositions nutritional supplements, dental supplements, and/or food products comprising a bacterial strain belonging to *Pediococcus pentosaceus*. In some embodiments, a composition nutritional supplement, dental supplement, and/or food product further comprises one or more additional bacterial strains are (b) a bacterial strain that reduces the pH of an environment from 7.5 or higher to less than 7.5; (c) a bacterial strain that reduces the abundance of one or more VSCs in an environment having a pH of less than 7.5; and (d) a bacterial strain that enhances the reduction of one or more VSCs by another bacterial strain (e.g., *Pediococcus pentosaceus*).

Some aspects relate to a composition comprising (a) a bacterial strain that reduces the abundance of one or more volatile sulfur compounds (VSCs) in an environment having a pH of 7.5 or higher; and one or more of (b) a bacterial strain that reduces the pH of an environment from 7.5 or higher to less than 7.5; (c) a bacterial strain that reduces the abundance of one or more VSCs in an environment having a pH of less than 7.5; and (d) a bacterial strain that enhances the reduction of one or more VSCs by the bacterial strain of (a). In some embodiments, the bacterial strain of (a) belongs to *Pediococcus pentosaceus*. In some embodiments, the bacterial strain of (b) belongs to *Pediococcus pentosaceus*. In some embodiments, the bacterial strain of (c) belongs to *Pediococcus pentosaceus*. In some embodiments, the bacterial strain of (d) belongs to *Pediococcus pentosaceus*.

In some embodiments, the bacterial strain of (b) belongs to any one of *Shouchella clausii, Bifidobacterium adolescentis, Bifidobacterium animalis, Bifidobacterium bifidum, Bifidobacterium longum, Bifidobacterium longum* subsp. *infantis, Bifidobacterium thermophilum, Enterococcus faecium, Enterococcus lactis, Lacticaseibacillus casei, Lactiplantibacillus plantarum, Lactobacillus acidophilus, Lactobacillus delbrueckii, Lactobacillus helveticus, Lactococcus cremoris, Lactococcus lactis, Latilactobacillus curvatus, Lentilactobacillus buchneri, Leuconostoc mesenteroides,*

*Levilactobacillus brevis, Ligilactobacillus animalis, Limosilactobacillus fermentum, Limosilactobacillus reuteri, Pediococcus acidilactici, Pediococcus damnosus, Pediococcus pentosaceus, Acidipropionibacterium acidipropionici, Propionibacterium freudenreichii, Propionibacterium freudenreichii* subsp. *shermanii, Streptococcus thermophilus, Streptococcus salivarius,* and *Weissella cibaria*. In some embodiments, the bacterial strain of (b) comprises a 16S rDNA sequence with at least 97% sequence identity to any one of SEQ ID NOs: 1, 2, 3, 4, 6, 8, 16, and 17. In some embodiments, the bacterial strain of (b) comprises a genome with at least 95.0% average nucleotide identity (ANI) and an alignment fraction (AF) of at least 65.0% to a reference genome of any one of Accession Nos. GCF_001437285.1, GCF_014131735.1, GCA_000463075.2, GCF_004101845.1, GCF_013394085.1, GCF_000014445.1, GCA_009676745.1, GCF_001591845.1, GCF_029023785.1, GCF_000196735.1, GCF_000193635.1, GCF_004521965.1, GCF_010120595.1, GCF_029023865.1, GCF_001441165.1, GCF_000010425.1, GCF_000260715.1, GCA_004154635.1, GCF_001025135.1, GCF_000196555.1, GCA_905202265.1, GCF_000269965.1, GCA_000741495.1, GCF_015751045.1, GCF_000829055.1, GCA_004556255.1, GCF_000160855.1, GCF_001591705.1, GCF_018314255.1, GCF_001433855.1, GCA_021383565.1, GCF_001434535.1, GCF_000016825.1, GCF_003072625.1, GCF_013694365.1, GCF_020784725.1, GCF_012971035.1, GCF_020784195.1, GCF_000146325.1, GCF_024970065.1, GCF_001437255.1, GCF_000940845.1, GCF_002250115.1, GCF_000785515.1, and GCF_002094975.1. In some embodiments, the bacterial strain of (b) comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to a reference genome of any one of Accession Nos. GCF_001437285.1, GCF_014131735.1, GCA_000463075.2, GCF_004101845.1, GCF_013394085.1, GCF_000014445.1, GCA_009676745.1, GCF_001591845.1, GCF_029023785.1, GCF_000196735.1, GCF_000193635.1, GCF_004521965.1, GCF_010120595.1, GCF_029023865.1, GCF_001441165.1, GCF_000010425.1, GCF_000260715.1, GCA_004154635.1, GCF_001025135.1, GCF_000196555.1, GCA_905202265.1, GCF_000269965.1, GCA_000741495.1, GCF_015751045.1, GCF_000829055.1, GCA_004556255.1, GCF_000160855.1, GCF_001591705.1, GCF_018314255.1, GCF_001433855.1, GCA_021383565.1, GCF_001434535.1, GCF_000016825.1, GCF_003072625.1, GCF_013694365.1, GCF_020784725.1, GCF_012971035.1, GCF_020784195.1, GCF_000146325.1, GCF_024970065.1, GCF_001437255.1, GCF_000940845.1, GCF_002250115.1, GCF_000785515.1, and GCF_002094975.1. In some embodiments, the bacterial strain of (b) comprises a genome with an AF of at least 65%, 70%, 75%, 80%, 85%, 90%, 91%, 92%, 93%, 94%, 95%, 96%, 97%, 98%, or 99% to a reference genome of any one of Accession Nos. GCF_001437285.1, GCF_014131735.1, GCA_000463075.2, GCF_004101845.1, GCF_013394085.1, GCF_000014445.1, GCA_009676745.1, GCF_001591845.1, GCF_029023785.1, GCF_000196735.1, GCF_000193635.1, GCF_004521965.1, GCF_010120595.1, GCF_029023865.1, GCF_001441165.1, GCF_000010425.1, GCF_000260715.1, GCA_004154635.1, GCF_001025135.1, GCF_000196555.1, GCA_905202265.1, GCF_000269965.1, GCA_000741495.1, GCF_015751045.1, GCF_000829055.1, GCA_004556255.1, GCF_000160855.1, GCF_001591705.1, GCF_018314255.1, GCF_001433855.1, GCA_021383565.1, GCF_001434535.1, GCF_000016825.1, GCF_003072625.1, GCF_013694365.1, GCF_020784725.1, GCF_012971035.1, GCF_020784195.1, GCF_000146325.1, GCF_024970065.1, GCF_001437255.1, GCF_000940845.1, GCF_002250115.1, GCF_000785515.1, and GCF_002094975.1.

In some embodiments, the bacterial strain of (b) comprises a genome with at least 95.0% average nucleotide identity (ANI) and an alignment fraction (AF) of at least 65.0% to a reference genome of any one of SEQ ID NOs: 18, 19, 20, 21, 22, 23, 25, 33, 34, 42, 46, 47, 50, and 55. In some embodiments, the bacterial strain of (b) comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to a reference genome of any one of SEQ ID NOs: 18, 19, 20, 21, 22, 23, 25, 33, 34, 42, 46, 47, 50, and 55. In some embodiments, the bacterial strain of (b) comprises a genome with an AF of at least 65%, 70%, 75%, 80%, 85%, 90%, 91%, 92%, 93%, 94%, 95%, 96%, 97%, 98%, or 99% to a reference genome of any one of SEQ ID NOs: 18, 19, 20, 21, 22, 23, 25, 33, 34, 42, 46, 47, 50, and 55.

In some embodiments, the bacterial strain of (c) belongs to any one of *Enterococcus faecium, Lactiplantibacillus plantarum, Lactobacillus acidophilus, Leuconostoc mesenteroides, Pediococcus acidilactici, Pediococcus pentosaceus, Weizmannia coagulans*, and *Streptococcus salivarius*. In some embodiments, the bacterial strain of (c) comprises a 16S rDNA sequence with at least 97% sequence identity to any one of SEQ ID NOs: 1, 2, 3, 6, 7, 8, 13, and 17. In some embodiments, the bacterial strain of (c) comprises a genome with at least 95.0% average nucleotide identity (ANI) and an alignment fraction (AF) of at least 65.0% to a reference genome of any one of Accession Nos. GCF_001437285.1, GCF_014131735.1, GCA_000463075.2, GCF_000014445.1, GCA_009676745.1, GCF_001591845.1, GCF_029023785.1, GCF_000290615.1, GCF_000146325.1, GCF_024970065.1, GCF_000785515.1, and GCF_002094975.1. In some embodiments, the bacterial strain of (c) comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to a reference genome of any one of Accession Nos. GCF_001437285.1, GCF_014131735.1, GCA_000463075.2, GCF_000014445.1, GCA_009676745.1, GCF_001591845.1, GCF_029023785.1, GCF_000290615.1, GCF_000146325.1, GCF_024970065.1, GCF_000785515.1, and GCF_002094975.1. In some embodiments, the bacterial strain of (c) comprises a genome with an AF of at least 65%, 70%, 75%, 80%, 85%, 90%, 91%, 92%, 93%, 94%, 95%, 96%, 97%, 98%, or 99% to a reference genome of any one of Accession Nos. GCF_001437285.1, GCF_014131735.1, GCA_000463075.2, GCF_000014445.1, GCA_009676745.1, GCF_001591845.1, GCF_029023785.1, GCF_000290615.1, GCF_000146325.1, GCF_024970065.1, GCF_000785515.1, and GCF_002094975.1.

In some embodiments, the bacterial strain of (c) comprises a genome with at least 95.0% average nucleotide identity (ANI) and an alignment fraction (AF) of at least 65.0% to a reference genome of any one of SEQ ID NOs: 18, 19, 20, 23, 25, 30, 34, and 50. In some embodiments, the bacterial strain of (c) comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to a reference genome of any one of SEQ ID NOs: 18, 19, 20, 23, 25, 30, 34, and 50. In some embodiments, the bacterial strain of (c) comprises a genome with an AF of at least 65%, 70%, 75%, 80%, 85%, 90%, 91%, 92%, 93%, 94%, 95%, 96%, 97%, 98%, or 99% to a reference genome of any one of SEQ ID NOs: 18, 19, 20, 23, 25, 30, 34, and 50.

In some embodiments, the bacterial strain of (d) belongs to any one of *Bacillus amyloliquefaciens, Bacillus licheniformis, Bacillus pumilus, Bacillus subtilis, Enterococcus faecium, Lactiplantibacillus plantarum, Lactococcus lactis, Latilactobacillus curvatus, Leuconostoc mesenteroides, Pediococcus pentosaceus*, and *Weizmannia coagulans*. In some embodiments, the bacterial strain of (d) comprises a 16S rDNA sequence with at least 97% sequence identity to any one of SEQ ID NOs: 1, 2, 3, 4, 6, 8, 9, 11, 12, 13, 14, 16, and 17. In some embodiments, the bacterial strain of (d) comprises a genome with at least 95.0% average nucleotide identity (ANI) and an alignment fraction (AF) of at least 65.0% to a reference genome of any one of Accession Nos. GCF_001437285.1, GCF_014131735.1, GCA_000463075.2, GCF_004101845.1, GCF_000014445.1, GCA_009676745.1, GCF_029023785.1, GCF_000009045.1, GCF_002153395.1, GCF_900186955.1, GCA_001938995.1, GCF_002744245.1, GCF_003431975.1, GCF_009937765.1, GCF_024498355.1, GCF_000011645.1, GCF_000196735.1, GCF_000290615.1, and GCF_029023865.1. In some embodiments, the bacterial strain of (d) comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to a reference genome of any one of Accession Nos. GCF_001437285.1, GCF_014131735.1, GCA_000463075.2, GCF_004101845.1, GCF_000014445.1, GCA_009676745.1, GCF_029023785.1, GCF_000009045.1, GCF_002153395.1, GCF_900186955.1, GCA_001938995.1, GCF_002744245.1, GCF_003431975.1, GCF_009937765.1, GCF_024498355.1, GCF_000011645.1, GCF_000196735.1, GCF_000290615.1, and GCF_029023865.1. In some embodiments, the bacterial strain of (d) comprises a genome with an AF of at least 65%, 70%, 75%, 80%, 85%, 90%, 91%, 92%, 93%, 94%, 95%, 96%, 97%, 98%, or 99% to a reference genome of any one of Accession Nos. GCF_001437285.1, GCF_014131735.1, GCA_000463075.2, GCF_004101845.1, GCF_000014445.1, GCA_009676745.1, GCF_029023785.1, GCF_000009045.1, GCF_002153395.1, GCF_900186955.1, GCA_001938995.1, GCF_002744245.1, GCF_003431975.1, GCF_009937765.1, GCF_024498355.1, GCF_000011645.1, GCF_000196735.1, GCF_000290615.1, and GCF_029023865.1.

In some embodiments, the bacterial strain of (d) comprises a genome with at least 95.0% average nucleotide identity (ANI) and an alignment fraction (AF) of at least 65.0% to a reference genome of any one of SEQ ID NOs: 18, 19, 20, 21, 23, 25, 26, 27, 28, 29, 30, 33, and 34. In some embodiments, the bacterial strain of (d) comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to a reference genome of any one of SEQ ID NOs: 18, 19, 20, 21, 23, 25, 26, 27, 28, 29, 30, 33, and 34. In some embodiments, the bacterial strain of (d) comprises a genome with an AF of at least 65%, 70%, 75%, 80%, 85%, 90%, 91%, 92%, 93%, 94%, 95%, 96%, 97%, 98%, or 99% to a reference genome of any one of SEQ ID NOs: 18, 19, 20, 21, 23, 25, 26, 27, 28, 29, 30, 33, and 34.

In some embodiments, the bacterial strain of (b) produces one or more organic acids. Non-limiting examples of organic acids that may be produced include acetic acid, lactic acid, citric acid, succinic acid, and propionic acid. In some embodiments, the bacterial strain of (c) produces hydrogen peroxide.

Exemplary bacterial strains determined to be capable of (b) reducing the pH of an environment from 7.5 or higher to less than 7.5; (c) reducing the abundance of one or more VSCs in an environment having a pH of less than 7.5; and/or (d) enhances the reduction of one or more VSCs by another bacterial strain in an environment with a pH of 7.5 or higher, are listed below in Table 1.

TABLE 1

Exemplary bacterial strains capable of (b) pH reduction, (c) VSC reduction, and/or (d) enhancement of VSC reduction by other bacterial strains.

| Bacterial strain | SEQ ID NO. of 16S rDNA | SEQ ID NO. of Genome (N50 score) | Species Representative Genome(s) (GTDB Release 220) | (b) | (c) | (d) |
|---|---|---|---|---|---|---|
| *Pediococcus pentosaceus* 1 | 1 | 18 (102085) | GCF_001437285.1 | Yes | Yes | Yes |
| *Lactiplantibacillus plantarum* 1 | 2 | 19 (348705) | GCF_014131735.1 GCA_000463075.2 | Yes | Yes | Yes |
| *Lactiplantibacillus plantarum* 2 | 3 | 20 (294228) | GCF_014131735.1 GCA_000463075.2 | Yes | Yes | Yes |
| *Latilactobacillus curvatus* | 4 | 21 (38261) | GCF_004101845.1 | Yes | | Yes |
| *Limosilactobacillus fermentum* | 5 | 22 (36270) | GCF_013394085.1 | Yes | | |
| *Leuconostoc mesenteroides* | 6 | 23 (320495) | GCF_000014445.1 GCA_009676745.1 | Yes | Yes | Yes |
| *Lactobacillus acidophilus* | 7 | | GCF_001591845.1 | Yes | Yes | |
| *Enterococcus faecium* | 8 | 25 (86815) | GCF_029023785.1 | Yes | Yes | Yes |
| *Bacillus subtilis* | 9 | 26 (1049998) | GCF_000009045.1 GCF_002153395.1 | | | Yes |
| *Bacillus pumilus* | 10 | 27 (797020) | GCF_900186955.1 GCA_001938995.1 GCF_002744245.1 GCF_003431975.1 GCF_009937765.1 GCF_024498355.1 | | | Yes |
| *Bacillus licheniformis* | 11 | 28 (498457) | GCF_000011645.1 | | | Yes |
| *Bacillus amyloliquefaciens* | 12 | 29 (930313) | GCF_000196735.1 | | | Yes |

TABLE 1-continued

Exemplary bacterial strains capable of (b) pH reduction, (c) VSC reduction, and/or (d) enhancement of VSC reduction by other bacterial strains.

| Bacterial strain | SEQ ID NO. of 16S rDNA | SEQ ID NO. of Genome (N50 score) | Species Representative Genome(s) (GTDB Release 220) | (b) | (c) | (d) |
|---|---|---|---|---|---|---|
| Weizmannia coagulans | 13 | 30 (73623) | GCF_000290615.1 | | Yes | Yes |
| Weissella cibaria | 14 | 31 (175040) | GCF_000193635.1 GCF_004521965.1 | Yes | | |
| Streptococcus thermophilus | 15 | | GCF_010120595.1 | Yes | | |
| Lactococcus lactis | 16 | 33 (87970) | GCF_029023865.1 | Yes | | Yes |
| Pediococcus pentosaceus 2 | 17 | 34 (354664) | GCF_001437285.1 | Yes | Yes | Yes |
| Shouchella clausii | | | GCF_002250115.1 | Yes | | |
| Bifidobacterium adolescentis | | | GCF_000010425.1 | Yes | | |
| Bifidobacterium animalis | | | GCF_000260715.1 GCA_004154635.1 | Yes | | |
| Bifidobacterium bifidum | | | GCF_001025135.1 | Yes | | |
| Bifidobacterium longum | | | GCF_000196555.1 GCA_905202265.1 | Yes | | |
| Bifidobacterium longum subsp. infantis | | | GCF_000269965.1 | Yes | | |
| Bifidobacterium thermophilum | | | GCA_000741495.1 | Yes | | |
| Enterococcus lactis | | 42 (231893) | GCF_015751045.1 | Yes | | |
| Lacticaseibacillus casei | | | GCF_000829055.1 | Yes | | |
| Lactobacillus delbrueckii | | | GCA_004556255.1 | Yes | | |
| Lactobacillus helveticus | | | GCF_000160855.1 | Yes | | |
| Lactococcus cremoris | | 46 (22905) | GCF_001591705.1 | Yes | | |
| Lentilactobacillus buchneri | | 47 (55786) | GCF_018314255.1 | Yes | | |
| Ligilactobacillus animalis | | | GCF_001434535.1 | Yes | | |
| Limosilactobacillus reuteri | | | GCF_000016825.1 GCF_003072625.1 GCF_013694365.1 GCF_020784725.1 GCF_012971035.1 GCF_020784195.1 | Yes | | |
| Pediococcus acidilactici | | 50 (392218) | GCF_000146325.1 GCF_024970065.1 | Yes | Yes | |
| Pediococcus damnosus | | | GCF_001437255.1 | Yes | | |
| Acidipropionibacterium acidipropionici | | | GCF_001441165.1 | Yes | | |
| Propionibacterium freudenreichii | | | GCF_000940845.1 | Yes | | |
| Propionibacterium freudenreichii subsp. shermanii | | | GCF_000940845.1 | Yes | | |
| Levilactobacillus brevis | | 55 (147458) | GCF_001433855.1 GCA_021383565.1 | Yes | | |
| Streptococcus salivarius | | | GCF_000785515.1 GCF_002094975.1 | Yes | Yes | |

Some embodiments of compositions, nutritional supplements, dental supplements, and/or food products comprise a bacterial mixture comprising: (i) a bacterial strain belonging to *Pediococcus pentosaceus*; (ii) a first bacterial strain belonging to *Lactiplantibacillus plantarum*; and (iii) a second bacterial strain belonging to *Lactiplantibacillus plantarum*. Some embodiments of the purified bacterial mixtures described herein comprise: (i) a bacterial strain comprising a 16S rDNA sequence with at least 97% sequence identity to the nucleic acid sequence of SEQ ID NO: 1; (ii) a bacterial strain comprising a 16S rDNA sequence with at least 97% sequence identity to the nucleic acid sequence of SEQ ID NO: 2; and (iii) a bacterial strain comprising a 16S rDNA sequence with at least 97% sequence identity to the nucleic acid sequence of SEQ ID NO: 3. In some embodiments, each of the three bacterial strains having 16S rDNA sequences with at least 97% sequence identity to SEQ ID NOs: 1, 2, and 3, respectively, comprise a different 16S rDNA sequence.

Some embodiments of compositions, nutritional supplements, dental supplements, and/or food products comprise a bacterial mixture comprising: (i) a first bacterial strain belonging to *Pediococcus pentosaceus*; and (ii) a second bacterial strain belonging to *Pediococcus pentosaceus*. Some embodiments of the purified bacterial mixtures described herein comprise: (i) a bacterial strain comprising a 16S rDNA sequence with at least 97% sequence identity to the nucleic acid sequence of SEQ ID NO: 1; and (ii) a bacterial strain comprising a 16S rDNA sequence with at least 97% sequence identity to the nucleic acid sequence of SEQ ID NO: 17. In some embodiments, each of the bacterial strains having 16S rDNA sequences with at least 97% sequence identity to SEQ ID NOs: 1 and 17, respectively, comprise a different 16S rDNA sequence.

Some embodiments of compositions, nutritional supplements, dental supplements, and/or food products comprise a bacterial mixture consisting of: (i) a bacterial strain belonging to *Pediococcus pentosaceus*; (ii) a first bacterial strain belonging to *Lactiplantibacillus plantarum*; and (iii) a second bacterial strain belonging to *Lactiplantibacillus plantarum*. Some embodiments of the purified bacterial mixtures described herein consist of: (i) a bacterial strain comprising a 16S rDNA sequence with at least 97% sequence identity to the nucleic acid sequence of SEQ ID NO: 1; (ii) a bacterial strain comprising a 16S rDNA sequence with at least 97% sequence identity to the nucleic acid sequence of SEQ ID NO: 2; and (iii) a bacterial strain comprising a 16S rDNA sequence with at least 97% sequence identity to the nucleic acid sequence of SEQ ID NO: 3. In some embodiments, each of the three bacterial strains having 16S rDNA sequences with at least 97% sequence identity to SEQ ID NOs: 1, 2, and 3, respectively, comprise a different 16S rDNA sequence.

In some embodiments, a bacterial strain, e.g. of a bacterial mixture, has a 16S rDNA sequence with at least 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, 99.9%, or 100% identity to SEQ ID NO: 1. In some embodiments, the bacterial strain comprising a 16S rDNA sequence with at least 97% sequence identity to SEQ ID NO: 1 belongs to the species *Pediococcus pentosaceus*.

In some embodiments, a bacterial strain of the bacterial mixture has a 16S rDNA sequence with at least 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, 99.9%, or 100% identity to SEQ ID NO: 2. In some embodiments, the bacterial strain comprising a 16S rDNA sequence with at least 97% sequence identity to SEQ ID NO: 2 belongs to the species *Lactiplantibacillus plantarum*. In some embodiments, the bacterial strain comprising a 16S rDNA sequence with at least 97% sequence identity to SEQ ID NO: 2 comprises a genome with at least 95.0% average nucleotide identity (ANI) and an alignment fraction (AF) of at least 65.0% to the reference genome of SEQ ID NO: 19. In some embodiments, the bacterial strain comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 19. In some embodiments, the bacterial strain comprises a genome with an AF of at least 65%, 70%, 75%, 80%, 85%, 90%, 91%, 92%, 93%, 94%, 95%, 96%, 97%, 98%, or 99% to the reference genome of SEQ ID NO: 19.

In some embodiments, a bacterial strain of the bacterial mixture has a 16S rDNA sequence with at least 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, 99.9%, or 100% identity to SEQ ID NO: 3. In some embodiments, the bacterial strain comprising a 16S rDNA sequence with at least 97% sequence identity to SEQ ID NO: 3 belongs to the species *Lactiplantibacillus plantarum*. In some embodiments, the bacterial strain comprising a 16S rDNA sequence with at least 97% sequence identity to SEQ ID NO: 3 comprises a genome with at least 95.0% average nucleotide identity (ANI) and an alignment fraction (AF) of at least 65.0% to the reference genome of SEQ ID NO: 20. In some embodiments, the bacterial strain comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 20. In some embodiments, the bacterial strain comprises a genome with an AF of at least 65%, 70%, 75%, 80%, 85%, 90%, 91%, 92%, 93%, 94%, 95%, 96%, 97%, 98%, or 99% to the reference genome of SEQ ID NO: 20.

In some embodiments, a bacterial strain of the bacterial mixture has a 16S rDNA sequence with at least 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, 99.9%, or 100% identity to SEQ ID NO: 4. In some embodiments, the bacterial strain comprising a 16S rDNA sequence with at least 97% sequence identity to SEQ ID NO: 4 belongs to the species *Latilactobacillus curvatus*. In some embodiments, the bacterial strain comprising a 16S rDNA sequence with at least 97% sequence identity to SEQ ID NO: 4 comprises a genome with at least 95.0% average nucleotide identity (ANI) and an alignment fraction (AF) of at least 65.0% to the reference genome of SEQ ID NO: 21. In some embodiments, the bacterial strain comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 21. In some embodiments, the bacterial strain comprises a genome with an AF of at least 65%, 70%, 75%, 80%, 85%, 90%, 91%, 92%, 93%, 94%, 95%, 96%, 97%, 98%, or 99% to the reference genome of SEQ ID NO: 21.

In some embodiments, a bacterial strain of the bacterial mixture has a 16S rDNA sequence with at least 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, 99.9%, or 100% identity to SEQ ID NO: 5. In some embodiments, the bacterial strain comprising a 16S rDNA sequence with at least 97% sequence identity to SEQ ID NO: 5 belongs to the species *Limosilactobacillus fermentum*. In some embodiments, the bacterial strain comprising a 16S rDNA sequence with at least 97% sequence identity to SEQ ID NO: 5 comprises a genome with at least 95.0% average nucleotide identity (ANI) and an alignment fraction (AF) of at least 65.0% to the reference genome of SEQ ID NO: 22. In some embodiments, the bacterial strain comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 22. In some embodiments, the bacterial strain comprises a genome with an AF of at least 65%, 70%, 75%, 80%, 85%, 90%, 91%, 92%, 93%, 94%, 95%, 96%, 97%, 98%, or 99% to the reference genome of SEQ ID NO: 22.

In some embodiments, a bacterial strain of the bacterial mixture has a 16S rDNA sequence with at least 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, 99.9%, or 100% identity to SEQ ID NO: 6. In some embodiments, the bacterial strain comprising a 16S rDNA sequence with at least 97% sequence identity to SEQ ID NO: 6 belongs to the species *Leuconostoc mesenteroides*. In some embodiments, the bacterial strain comprising a 16S rDNA sequence with at least 97% sequence identity to SEQ ID NO: 6 comprises a genome with at least 95.0% average nucleotide identity (ANI) and an alignment fraction (AF) of at least 65.0% to the reference genome of SEQ ID NO: 23. In some embodiments, the bacterial strain comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 23. In some embodiments, the bacterial strain comprises a genome with an AF of at least 65%, 70%, 75%, 80%, 85%, 90%, 91%, 92%, 93%, 94%, 95%, 96%, 97%, 98%, or 99% to the reference genome of SEQ ID NO: 23.

In some embodiments, a bacterial strain of the bacterial mixture has a 16S rDNA sequence with at least 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, 99.9%, or 100% identity to SEQ ID NO: 7.

In some embodiments, a bacterial strain of the bacterial mixture has a 16S rDNA sequence with at least 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, 99.9%, or 100% identity to SEQ ID NO: 8. In some embodiments, the bacterial strain comprising a 16S rDNA sequence with at least 97% sequence identity to SEQ ID NO: 8 belongs to the species *Enterococcus faecium*. In some embodiments, the bacterial strain comprising a 16S rDNA sequence with at least 97% sequence identity to SEQ ID NO: 8 comprises a genome with at least 95.0% average nucleotide identity (ANI) and an alignment fraction (AF) of at least 65.0% to the reference genome of SEQ ID NO: 25. In some embodiments, the bacterial strain comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 25. In some embodiments, the bacterial strain comprises a genome with an AF of at least 65%, 70%, 75%, 80%, 85%, 90%, 91%, 92%, 93%, 94%, 95%, 96%, 97%, 98%, or 99% to the reference genome of SEQ ID NO: 25.

In some embodiments, a bacterial strain of the bacterial mixture has a 16S rDNA sequence with at least 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, 99.9%, or 100% identity to SEQ ID NO: 9. In some embodiments, the bacterial strain comprising a 16S rDNA sequence with at least 97% sequence identity to SEQ ID NO: 9 belongs to the species *Bacillus subtilis*. In some embodiments, the bacterial strain comprising a 16S rDNA sequence with at least 97% sequence identity to SEQ ID NO: 9 comprises a genome with at least 95.0% average nucleotide identity (ANI) and an alignment fraction (AF) of at least 65.0% to the reference genome of SEQ ID NO: 26. In some embodiments, the bacterial strain comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 26. In some embodiments, the bacterial strain comprises a genome with an AF of at least 65%, 70%, 75%, 80%, 85%, 90%, 91%, 92%, 93%, 94%, 95%, 96%, 97%, 98%, or 99% to the reference genome of SEQ ID NO: 26.

In some embodiments, a bacterial strain of the bacterial mixture has a 16S rDNA sequence with at least 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, 99.9%, or 100% identity to SEQ ID NO: 10. In some embodiments, the bacterial strain comprising a 16S rDNA sequence with at least 97% sequence identity to SEQ ID NO: 10 belongs to the species *Bacillus pumilus*. In some embodiments, the bacterial strain comprising a 16S rDNA sequence with at least 97% sequence identity to SEQ ID NO: 10 comprises a genome with at least 95.0% average nucleotide identity (ANI) and an alignment fraction (AF) of at least 65.0% to the reference genome of SEQ ID NO: 27. In some embodiments, the bacterial strain comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 27. In some embodiments, the bacterial strain comprises a genome with an AF of at least 65%, 70%, 75%, 80%, 85%, 90%, 91%, 92%, 93%, 94%, 95%, 96%, 97%, 98%, or 99% to the reference genome of SEQ ID NO: 27.

In some embodiments, a bacterial strain of the bacterial mixture has a 16S rDNA sequence with at least 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, 99.9%, or 100% identity to SEQ ID NO: 11. In some embodiments, the bacterial strain comprising a 16S rDNA sequence with at least 97% sequence identity to SEQ ID NO: 11 belongs to the species *Bacillus licheniformis*. In some embodiments, the bacterial strain comprising a 16S rDNA sequence with at least 97% sequence identity to SEQ ID NO: 11 comprises a genome with at least 95.0% average nucleotide identity (ANI) and an alignment fraction (AF) of at least 65.0% to the reference genome of SEQ ID NO: 28. In some embodiments, the bacterial strain comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 28. In some embodiments, the bacterial strain comprises a genome with an AF of at least 65%, 70%, 75%, 80%, 85%, 90%, 91%, 92%, 93%, 94%, 95%, 96%, 97%, 98%, or 99% to the reference genome of SEQ ID NO: 28.

In some embodiments, a bacterial strain of the bacterial mixture has a 16S rDNA sequence with at least 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, 99.9%, or 100% identity to SEQ ID NO: 12. In some embodiments, the bacterial strain comprising a 16S rDNA sequence with at least 97% sequence identity to SEQ ID NO: 12 belongs to the species *Bacillus amyloliquefaciens*. In some embodiments, the bacterial strain comprising a 16S rDNA sequence with at least 97% sequence identity to SEQ ID NO: 12 comprises a genome with at least 95.0% average nucleotide identity (ANI) and an alignment fraction (AF) of at least 65.0% to the reference genome of SEQ ID NO: 29. In some embodiments, the bacterial strain comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 29. In some embodiments, the bacterial strain comprises a genome with an AF of at least 65%, 70%, 75%, 80%, 85%, 90%, 91%, 92%, 93%, 94%, 95%, 96%, 97%, 98%, or 99% to the reference genome of SEQ ID NO: 29.

In some embodiments, a bacterial strain of the bacterial mixture has a 16S rDNA sequence with at least 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, 99.9%, or 100% identity to SEQ ID NO: 13. In some embodiments, the bacterial strain comprising a 16S rDNA sequence with at least 97% sequence identity to SEQ ID NO: 13 belongs to the species *Weizmannia coagulans*. In some embodiments, the bacterial strain comprising a 16S rDNA sequence with at least 97% sequence identity to SEQ ID NO: 13 comprises a genome with at least 95.0% average nucleotide identity (ANI) and an alignment fraction (AF) of at least 65.0% to the reference genome of SEQ ID NO: 30. In some embodiments, the bacterial strain comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 30. In some embodiments, the bacterial strain comprises a genome with an AF of at least 65%, 70%, 75%, 80%, 85%, 90%, 91%, 92%, 93%, 94%, 95%, 96%, 97%, 98%, or 99% to the reference genome of SEQ ID NO: 30.

In some embodiments, a bacterial strain of the bacterial mixture has a 16S rDNA sequence with at least 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, 99.9%, or 100% identity to SEQ ID NO: 14. In some embodiments, the bacterial strain comprising a 16S rDNA sequence with at least 97% sequence identity to SEQ ID NO: 14 belongs to the species *Weissella cibaria*. In some embodiments, the bacterial strain comprising a 16S rDNA sequence with at least 97% sequence identity to SEQ ID NO: 14 comprises a genome with at least 95.0% average nucleotide identity (ANI) and an alignment fraction (AF) of at least 65.0% to the reference genome of SEQ ID NO: 31. In some embodiments, the bacterial strain comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 31. In some embodiments, the bacterial strain comprises a genome with an AF of at least 65%, 70%, 75%, 80%, 85%, 90%, 91%, 92%, 93%, 94%, 95%, 96%, 97%, 98%, or 99% to the reference genome of SEQ ID NO: 31.

In some embodiments, a bacterial strain of the bacterial mixture has a 16S rDNA sequence with at least 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, 99.9%, or 100% identity to SEQ ID NO: 15. In some embodiments, the bacterial strain comprising a 16S rDNA sequence with at least 97% sequence identity to SEQ ID NO: 15 belongs to the species *Streptococcus salivarius*.

In some embodiments, a bacterial strain of the bacterial mixture has a 16S rDNA sequence with at least 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, 99.9%, or 100% identity to SEQ ID NO: 16. In some embodiments, the bacterial strain comprising a 16S rDNA sequence with at least 97% sequence identity to SEQ ID NO: 16 belongs to the species *Lactococcus lactis*. In some embodiments, the bacterial strain comprising a 16S rDNA sequence with at least 97% sequence identity to SEQ ID NO: 16 comprises a genome with at least 95.0% average nucleotide identity (ANI) and an alignment fraction (AF) of at least 65.0% to the reference genome of SEQ ID NO: 33. In some embodiments, the bacterial strain comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 33. In some embodiments, the bacterial strain comprises a genome with an AF of at least 65%, 70%, 75%, 80%, 85%, 90%, 91%, 92%, 93%, 94%, 95%, 96%, 97%, 98%, or 99% to the reference genome of SEQ ID NO: 33.

In some embodiments, a bacterial strain of the bacterial mixture has a 16S rDNA sequence with at least 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, 99.9%, or 100% identity to SEQ ID NO: 17. In some embodiments, the bacterial strain comprising a 16S rDNA sequence with at least 97% sequence identity to SEQ ID NO: 17 belongs to the species *Pediococcus pentosaceus*. In some embodiments, the bacterial strain comprising a 16S rDNA sequence with at least 97% sequence identity to SEQ ID NO: 17 comprises a genome with at least 95.0% average nucleotide identity (ANI) and an alignment fraction (AF) of at least 65.0% to the reference genome of SEQ ID NO: 18 or 34. In some embodiments, the bacterial strain comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 18 or 34. In some embodiments, the bacterial strain comprises a genome with an AF of at least 65%, 70%, 75%, 80%, 85%, 90%, 91%, 92%, 93%, 94%, 95%, 96%, 97%, 98%, or 99% to the reference genome of SEQ ID NO: 18 or 34.

In some embodiments, a bacterial strain belonging to the species *Enterococcus lactis* comprises a genome with at least 95.0% average nucleotide identity (ANI) and an alignment fraction (AF) of at least 65.0% to the reference genome of SEQ ID NO: 42. In some embodiments, the bacterial strain comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 42. In some embodiments, the bacterial strain comprises a genome with an AF of at least 65%, 70%, 75%, 80%, 85%, 90%, 91%, 92%, 93%, 94%, 95%, 96%, 97%, 98%, or 99% to the reference genome of SEQ ID NO: 42.

In some embodiments, a bacterial strain belonging to the species *Lactococcus cremoris* comprises a genome with at least 95.0% average nucleotide identity (ANI) and an alignment fraction (AF) of at least 65.0% to the reference genome of SEQ ID NO: 46. In some embodiments, the bacterial strain comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 46. In some embodiments, the bacterial strain comprises a genome with an AF of at least 65%, 70%, 75%, 80%, 85%, 90%, 91%, 92%, 93%, 94%, 95%, 96%, 97%, 98%, or 99% to the reference genome of SEQ ID NO: 46.

In some embodiments, a bacterial strain belonging to the species *Lentilactobacillus buchneri* comprises a genome with at least 95.0% average nucleotide identity (ANI) and an alignment fraction (AF) of at least 65.0% to the reference genome of SEQ ID NO: 47. In some embodiments, the bacterial strain comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 47. In some embodiments, the bacterial strain comprises a genome with an AF of at least 65%, 70%, 75%, 80%, 85%, 90%, 91%, 92%, 93%, 94%, 95%, 96%, 97%, 98%, or 99% to the reference genome of SEQ ID NO: 47.

In some embodiments, a bacterial strain belonging to the species *Pediococcus acidilactici* comprises a genome with at least 95.0% average nucleotide identity (ANI) and an alignment fraction (AF) of at least 65.0% to the reference genome of SEQ ID NO: 50. In some embodiments, the bacterial strain comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 50. In some embodiments, the bacterial strain comprises a genome with an AF of at least 65%, 70%, 75%, 80%, 85%, 90%, 91%, 92%, 93%, 94%, 95%, 96%, 97%, 98%, or 99% to the reference genome of SEQ ID NO: 50.

In some embodiments, a bacterial strain belonging to the species *Levilactobacillus brevis* comprises a genome with at least 95.0% average nucleotide identity (ANI) and an alignment fraction (AF) of at least 65.0% to the reference genome of SEQ ID NO: 55. In some embodiments, the bacterial strain comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 55. In some embodiments, the bacterial strain comprises a genome with an AF of at least 65%, 70%, 75%, 80%, 85%, 90%, 91%, 92%, 93%, 94%, 95%, 96%, 97%, 98%, or 99% to the reference genome of SEQ ID NO: 55.

The bacterial strain comprising a 16S rDNA sequence provided by SEQ ID NO: 1 (also referred to herein as "Strain 1") has the highest homology with a bacterial strain of the species *Pediococcus pentosaceus*:

```
Strain 1 16S ribosomal RNA coding sequence (16S rDNA)
                                                        (SEQ ID NO: 1)
ATGAGAGTTTGATCTTGGCTCAGGATGAACGCTGGCGGCGTGCCTAATACATGCAAGTCGAACGAACTTCCGTTAAT

TGATTATGACGTACTTGTACTGATTGAGATTTTAACACGAAGTGAGTGGCGAACGGGTGAGTAACACGTGGGTAACC

TGCCCAGAAGTAGGGGATAACACCTGGAAACAGATGCTAATACCGTATAACAGAGAAAACCGCATGGTTTTCTTTTA

AAAGATGGCTCTGCTATCACTTCTGGATGGACCCGCGGCGTATTAGCTAGTTGGTGAGGTAAAGGCTCACCAAGGCA

GTGATACGTAGCCGACCTGAGAGGGTAATCGGCCACATTGGGACTGAGACACGGCCCAGACTCCTACGGGAGGCAGC

AGTAGGGAATCTTCCACAATGGACGCAAGTCTGATGGAGCAACGCCGCGTGAGTGAAGAAGGGTTTCGGCTCGTAAA

GCTCTGTTGTTAAAGAAGAACGTGGGTAAGAGTAACTGTTTACCCAGTGACGGTATTTAACCAGAAAGCCACGGCTA

ACTACGTGCCAGCAGCCGCGGTAATACGTAGGTGGCAAGCGTTATCCGGATTTATTGGGCGTAAAGCGAGCGCAGGC

GGTCTTTTAAGTCTAATGTGAAAGCCTTCGGCTCAACCGAAGAAGTGCATTGGAAACTGGGAGACTTGAGTGCAGAA

GAGGACAGTGGAACTCCATGTGTAGCGGTGAAATGCGTAGATATATGGAAGAACACCAGTGGCGAAGGCGGCTGTCT

GGTCTGCAACTGACGCTGAGGCTCGAAAGCATGGGTAGCGAACAGGATTAGATACCCTGGTAGTCCATGCCGTAAAC

GATGATTACTAAGTGTTGGAGGGTTTCCGCCCTTCAGTGCTGCAGCTAACGCATTAAGTAATCCGCCTGGGGAGTAC

GACCGCAAGGTTGAAACTCAAAAGAATTGACGGGGGCCCGCACAAGCGGTGGAGCATGTGGTTTAATTCGAAGCTAC

GCGAAGAACCTTACCAGGTCTTGACATCTTCTGACAGTCTAAGAGATTAGAGGTTCCCTTCGGGGACAGAATGACAG

GTGGTGCATGGTTGTCGTCAGCTCGTGTCGTGAGATGTTGGGTTAAGTCCCGCAACGAGCGCAACCCTTATTACTAG

TTGCCAGCATTAAGTTGGGCACTCTAGTGAGACTGCCGGTGACAAACCGGAGGAAGGTGGGGACGACGTCAAATCAT

CATGCCCCTTATGACCTGGGCTACACACGTGCTACAATGGATGGTACAACGAGTCGCGAGACCGCGAGGTTAAGCTA

ATCTCTTAAAACCATTCTCAGTTCGGACTGTAGGCTGCAACTCGCCTACACGAAGTCGGAATCGCTAGTAATCGCGG

ATCAGCATGCCGCGGTGAATACGTTCCCGGGCCTTGTACACACCGCCCGTCACACCATGAGAGTTTGTAACACCCAA

AGCCGGTGGGGTAACCTTTTAGGAGCTAGCCGTCTAAGGTGGGACAGATGATTAGGGTGAAGTCGTAACAAGGTAGC

CGTAGGAGAACCTGCGGCTGGATCACCTCCTT
```

The bacterial strain comprising a 16S rDNA sequence provided by SEQ ID NO: 2 (also referred to herein as "Strain 2") has the highest homology with a bacterial strain of the species *Lactiplantibacillus plantarum*:

```
Strain 2 16S ribosomal RNA coding sequence (16S rDNA)
                                                        (SEQ ID NO: 2)
TTTGAGAGTTTGATCCTGGCTCAGGACGAACGCTGGCGGCGTGCCTAATACATGCAAGTCGAACGAACTCTGGTATT

GATTGGTGCTTGCATCATGATTTACATTTGAGTGAGTGGCGAACTGGTGAGTAACACGTGGGAAACCTGCCCAGAAG

CGGGGGATAACACCTGGAAACAGATGCTAATACCGCATAACAACTTGGACCGCATGGTCCGAGTTTGAAAGATGGCT

TCGGCTATCACTTTTGGATGGTCCCGCGGCGTATTAGCTAGATGGTGGGGTAACGGCTCACCATGGCAATGATACGT

AGCCGACCTGAGAGGGTAATCGGCCACATTGGGACTGAGACACGGCCCAAACTCCTACGGGAGGCAGCAGTAGGGAA

TCTTCCACAATGGACGAAAGTCTGATGGAGCAACGCCGCGTGAGTGAAGAAGGGTTTCGGCTCGTAAAACTCTGTTG

TTAAAGAAGAACATATCTGAGAGTAACTGTTCAGGTATTGACGGTATTTAACCAGAAAGCCACGGCTAACTACGTGC

CAGCAGCCGCGGTAATACGTAGGTGGCAAGCGTTGTCCGGATTTATTGGGCGTAAAGCGAGCGCAGGCGGTTTTTTA
```

-continued

```
AGTCTGATGTGAAAGCCTTCGGCTCAACCGAAGAAGTGCATCGGAAACTGGGAAACTTGAGTGCAGAAGAGGACAGT

GGAACTCCATGTGTAGCGGTGAAATGCGTAGATATATGGAAGAACACCAGTGGCGAAGGCGGCTGTCTGGTCTGTAA

CTGACGCTGAGGCTCGAAAGTATGGGTAGCAAACAGGATTAGATACCCTGGTAGTCCATACCGTAAACGATGAATGC

TAAGTGTTGGAGGGTTTCCGCCCTTCAGTGCTGCAGCTAACGCATTAAGCATTCCGCCTGGGGAGTACGGCCGCAAG

GCTGAAACTCAAAGGAATTGACGGGGGCCCGCACAAGCGGTGGAGCATGTGGTTTAATTCGAAGCTACGCGAAGAAC

CTTACCAGGTCTTGACATACTATGCAAATCTAAGAGATTAGACGTTCCCTTCGGGGACATGGATACAGGTGGTGCAT

GGTTGTCGTCAGCTCGTGTCGTGAGATGTTGGGTTAAGTCCCGCAACGAGCGCAACCCTTATTATCAGTTGCCAGCA

TTAAGTTGGGCACTCTGGTGAGACTGCCGGTGACAAACCGGAGGAAGGTGGGGATGACGTCAAATCATCATGCCCCT

TATGACCTGGGCTACACACGTGCTACAATGGATGGTACAACGAGTTGCGAACTCGCGAGAGTAAGCTAATCTCTTAA

AGCCATTCTCAGTTCGGATTGTAGGCTGCAACTCGCCTACATGAAGTCGGAATCGCTAGTAATCGCGGATCAGCATG

CCGCGGTGAATACGTTCCCGGGCCTTGTACACACCGCCCGTCACACCATGAGAGTTTGTAACACCCAAAGTCGGTGG

GGTAACCTTTTAGGAACCAGCCGCCTAAGGTGGGACAGATGATTAGGGTGAAGTCGTAACAAGGTAGCCGTAGGAGA

ACCTGCGGCTGGATCACCTCCTT
```

The bacterial strain comprising a 16S rDNA sequence provided by SEQ ID NO: 3 (also referred to herein as "Strain 3") has the highest homology with a bacterial strain of the species *Lactiplantibacillus plantarum*:

```
Strain 3 16S ribosomal RNA coding sequence (16S rDNA)
                                                           (SEQ ID NO: 3)
TTTGAGAGTTTGATCCTGGCTCAGGACGAACGCTGGCGGCGTGCCTAATACATGCAAGTCGAACGAACTCTGGTATT

GATTGGTGCTTGCATCATGATTTACATTTGAGTGAGTGGCGAACTGGTGAGTAACACGTGGGAAACCTGCCCAGAAG

CGGGGGATAACACCTGGAAACAGATGCTAATACCGCATAACAACTTGGACCGCATGGTCCGAGTTTGAAAGATGGCT

TCGGCTATCACTTTTGGATGGTCCCGCGGCGTATTAGCTAGATGGTGAGGTAACGGCTCACCATGGCAATGATACGT

AGCCGACCTGAGAGGGTAATCGGCCACATTGGGACTGAGACACGGCCCAAACTCCTACGGGAGGCAGCAGTAGGGAA

TCTTCCACAATGGACGAAAGTCTGATGGAGCAACGCCGCGTGAGTGAAGAAGGGTTTCGGCTCGTAAAACTCTGTTG

TTAAAGAAGAACATATCTGAGAGTAACTGTTCAGGTATTGACGGTATTTAACCAGAAAGCCACGGCTAACTACGTGC

CAGCAGCCGCGGTAATACGTAGGTGGCAAGCGTTGTCCGGATTTATTGGGCGTAAAGCGAGCGCAGGCGGTTTTTTA

AGTCTGATGTGAAAGCCTTCGGCTCAACCGAAGAAGTGCATCGGAAACTGGGAAACTTGAGTGCAGAAGAGGACAGT

GGAACTCCATGTGTAGCGGTGAAATGCGTAGATATATGGAAGAACACCAGTGGCGAAGGCGGCTGTCTGGTCTGTAA

CTGACGCTGAGGCTCGAAAGTATGGGTAGCAAACAGGATTAGATACCCTGGTAGTCCATACCGTAAACGATGAATGC

TAAGTGTTGGAGGGTTTCCGCCCTTCAGTGCTGCAGCTAACGCATTAAGCATTCCGCCTGGGGAGTACGGCCGCAAG

GCTGAAACTCAAAGGAATTGACGGGGGCCCGCACAAGCGGTGGAGCATGTGGTTTAATTCGAAGCTACGCGAAGAAC

CTTACCAGGTCTTGACATACTATGCAAATCTAAGAGATTAGACGTTCCCTTCGGGGACATGGATACAGGTGGTGCAT

GGTTGTCGTCAGCTCGTGTCGTGAGATGTTGGGTTAAGTCCCGCAACGAGCGCAACCCTTATTATCAGTTGCCAGCA

TTAAGTTGGGCACTCTGGTGAGACTGCCGGTGACAAACCGGAGGAAGGTGGGGATGACGTCAAATCATCATGCCCCT

TATGACCTGGGCTACACACGTGCTACAATGGATGGTACAACGAGTTGCGAACTCGCGAGAGTAAGCTAATCTCTTAA

AGCCATTCTCAGTTCGGATTGTAGGCTGCAACTCGCCTACATGAAGTCGGAATCGCTAGTAATCGCGGATCAGCATG

CCGCGGTGAATACGTTCCCGGGCCTTGTACACACCGCCCGTCACACCATGAGAGTTTGTAACACCCAAAGTCGGTGG

GGTAACCTTTTAGGAACCAGCCGCCTAAGGTGGGACAGATGATTAGGGTGAAGTCGTAACAAGGTAGCCGTAGGAGA

ACCTGCGGCTGGATCACCTCCTT
```

The bacterial strain comprising a 16S rDNA sequence provided by SEQ ID NO: 4 (also referred to herein as "Strain 4") has the highest homology with a bacterial strain of the species *Latilactobacillus curvatus*:

```
Strain 4 16S ribosomal RNA coding sequence (16S rDNA)
                                                         (SEQ ID NO: 4)
AAGTTTGATTATAGCTCAGGACGAACGCTGGCGGCGTGCCTAATACATGCAAGTCGAACGCACTCTCGTTAGATTGA

AGAAGCTTGCTTCTGATTGATAACATTTGAGTGAGTGGCGGACGGGTGAGTAACACGTGGGTAACCTGCCCTAAAGT

GGGGGATAACATTTCGGAAACAGATGCTAATACCGCATAAAACCTAACACCGCATGGTGCAAGGTTGAAAGATGGTT

TCGGCTATCACTTTAGGATGGACCCGCGGTGCATTAGTTAGTTGGTGAGGTAAAGGCTCACCAAGACCGTGATGCAT

AGCCGACCTGAGAGGGTAATCGGCCACACTGGGACTGAGACACGGCCCAGACTCCTACGGGAGGCAGCAGTAGGGAA

TCTTCCACAATGGACGAAAGTCTGATGGAGCAACGCCGCGTGAGTGAAGAAGGTTTTCGGATCGTAAAACTCTGTTG

TTGGAGAAGAACGTATTTGATAGTAACTGATCAGGTAGTGACGGTATCCAACCAGAAAGCCACGGCTAACTACGTGC

CAGCAGCCGCGGTAATACGTAGGTGGCAAGCGTTGTCCGGATTTATTGGGCGTAAAGCGAGCGCAGGCGGTTTCTTA

AGTCTGATGTGAAAGCCTTCGGCTCAACCGAAGAAGTGCATCGGAAACTGGGAAACTTGAGTGCAGAAGAGGACAGT

GGAACTCCATGTGTAGCGGTGAAATGCGTAGATATATGGAAGAACACCAGTGGCGAAGGCGGATGTCTGGTCTGTAA

CTGACGCTGAGGCTCGAAAGCATGGGTAGCAAACAGGATTAGATACCCTGGTAGTCCATGCCGTAAACGATGAGTGC

TAGGTGTTGGAGGGTTTCCGCCCTTCAGTGCCGCAGCTAACGCATTAAGCACTCCGCCTGGGGAGTACGACCGCAAG

GTTGAAACTCAAAGGAATTGACGGGGGCCCGCACAAGCGGTGGAGCATGTGGTTTAATTCGAAGCAACGCGAAGAAC

CTTACCAGGTCTTGACATCCTTTGACCACTCTAGAGATAGAGCTTTCCCTTCGGGGACAAAGTGACAGGTGGTGCAT

GGTTGTCGTCAGCTCGTGTCGTGAGATGTTGGGTTAAGTCCCGCAACGAGCGCAACCCTTATTACTAGTTGCCAGCA

TTTAGTTGGGCACTCTAGTGAGACTGCCGGTGACAAACCGGAGGAAGGTGGGGACGACGTCAAATCATCATGCCCCT

TATGACCTGGGCTACACACGTGCTACAATGGATGGTACAACGAGTCGCGAGACCGCGAGGTTTAGCTAATCTCTTAA

AACCATTCTCAGTTCGGATTGTAGGCTGCAACTCGCCTACATGAAGCCGGAATCGCTAGTAATCGCGGATCAGCATG

CCGCGGTGAATACGTTCCCGGGCCTTGTACACACCGCCCGTCACACCATGAGAGTTTGTAACACCCAAAGCCGGTGA

GGTAACCTTCGGGAGCCAGCCGTCTCAAGGTGGGACAGATGATTAGGGTGAAGTCGTAACAAGGTAGCCGTAGAGAAC

CTGCGGCTGGATCACCTCT
```

The bacterial strain comprising a 16S rDNA sequence provided by SEQ ID NO: 5 (also referred to herein as "Strain 5") has the highest homology with a bacterial strain of the species *Limosilactobacillus fermentum*:

```
Strain 5 16S ribosomal RNA coding sequence (16S rDNA)
                                                         (SEQ ID NO: 5)
CGGCGGTGTGCCTAATACATGCAAGTCGAACGCGTTGGCCCAATTGATTGATGGTGCTTGCACCTGATTGATTTTGG

TCGCCAACGAGTGGCGGACGGGTGAGTAACACGTAGGTAACCTGCCCAGAAGCGGGGGACAACATTTGGAAACAGAT

GCTAATACCGCATAACAACGTTGTTCGCATGAACAACGCTTAAAAGATGGCTTCTCGCTATCACTTCTGGATGGACC

TGCGGTGCATTAGCTTGTTGGTGGGGTAACGGCCTACCAAGGCGATGATGCATAGCCGAGTTGAGAGACTGATCGGC

CACAATGGGACTGAGACACGGCCCATACTCCTACGGGAGGCAGCAGTAGGGAATCTTCCACAATGGGCGCAAGCCTG

ATGGAGCAACACCGCGTGAGTGAAGAAGGGTTTCGGCTCGTAAAGCTCTGTTGTTAAAGAAGAACACGTATGAGAGT

AACTGTTCATACGTTGACGGTATTTAACCAGAAAGTCACGGCTAACTACGTGCCAGCAGCCGCGGTAATACGTAGGT

GGCAAGCGTTATCCGGATTTATTGGGCGTAAAGAGAGTGCAGGCGGTTTTCTAAGTCTGATGTGAAAGCCTTCGGCT

TAACCGGAGAAGTGCATCGGAAACTGGATAACTTGAGTGCAGAAGAGGGTAGTGGAACTCCATGTGTAGCGGTGGAA

TGCGTAGATATATGGAAGAACACCAGTGGCGAAGGCGGCTACCTGGTCTGCAACTGACGCTGAGACTCGAAAGCATG

GGTAGCGAACAGGATTAGATACCCTGGTAGTCCATGCCGTAAACGATGAGTGCTAGGTGTTGGAGGGTTTCCGCCCT

TCAGTGCCGGAGCTAACGCATTAAGCACTCCGCCTGGGGAGTACGACCGCAAGGTTGAAACTCAAAGGAATTGACGG
```

-continued

GGGCCCGCACAAGCGGTGGAGCATGTGGTTTAATTCGAAGCTACGCGAAGAACCTTACCAGGTCTTGACATCTTGCG

CCAACCCTAGAGATAGGGCGTTTCCTTCGGGAACGCAATGACAGGTGGTGCATGGTCGTCGTCAGCTCGTGTCGTGA

GATGTTGGGTTAAGTCCCGCAACGAGCGCAACCCTTGTTACTAGTTGCCAGCATTAAGTTGGGCACTCTAGTGAGAC

TGCCGGTGACAAACCGGAGGAAGGTGGGGACGACGTCAGATCATCATGCCCCTTATGACCTGGGCTACACACGTGCT

ACAATGGACGGTACAACGAGTCGCGAACTCGCGAGGGCAAGCAAATCTCTTAAAACCGTTCTCAGTTCGGACTGCAG

GCTGCAACTCGCCTGCACGAAGTCGGAATCGCTAGTAATCGCGGATCAGCATGCCGCGGTGAATACGTTCCCGGGCC

TTGTACACACCGCCCGTCACACCATGAGAGTTTGTAACACCCAAAGTCGGTGGGGTAACCTTTTAGGAGCCAGCCGC

CTAAGGTGGGACAGATGATTAGGGTGAAGTCGTAACAAG

The bacterial strain comprising a 16S rDNA sequence [15] provided by SEQ ID NO: 6 (also referred to herein as "Strain 6") has the highest homology with a bacterial strain of the species *Leuconostoc mesenteroides*:

Strain 6 16S ribosomal RNA coding sequence (16S rDNA)

(SEQ ID NO: 6)

CTGGCGGCGTGCCTAATACATGCAAGTCGAACGCATAGCGAAAGGTGCTTGCACCTTTCAAGTGAGTGGCGAACGGG

TGAGTAACACGTGGACAACCTGCCTCAAGGCTGGGGATAACATTTGGAAACAGATGCTAATACCGAATAAAACTTAG

TGTCGCATGACACAAAGTTAAAAGGCGCTTCGGCGTCACCTAGAGATGGATCCGCGGTGCATTAGTTAGTTGGTGGG

GTAAAGGCCTACCAAGACAATGATGCATAGCCGAGTTGAGAGACTGATCGGCCACATTGGGACTGAGACACGGCCCA

AACTCCTACGGGAGGCTGCAGTAGGGAATCTTCCACAATGGGCGAAAGCCTGATGGAGCAACGCCGCGTGTGTGATG

AAGGCTTTCGGGTCGTAAAGCACTGTTGTATGGGAAGAACAGCTAGAATAGGAAATGATTTTAGTTTGACGGTACCA

TACCAGAAAGGGACGGCTAAATACGTGCCAGCAGCCGCGGTAATACGTATGTCCCGAGCGTTATCCGGATTTATTGG

GCGTAAAGCGAGCGCAGACGGTTTATTAAGTCTGATGTGAAAGCCCGGAGCTCAACTCCGGAATGGCATTGGAAACT

GGTTAACTTGAGTGCAGTAGAGGTAAGTGGAACTCCATGTGTAGCGGTGGAATGCGTAGATATATGGAAGAACACCA

GTGGCGAAGGCGGCTTACTGGACTGCAACTGACGTTGAGGCTCGAAAGTGTGGGTAGCAAACAGGATTAGATACCCT

GGTAGTCCACACCGTAAACGATGAACACTAGGTGTTAGGAGGTTTCCGCCTCTTAGTGCCGAAGCTAACGCATTAAG

TGTTCCGCCTGGGGAGTACGACCGCAAGGTTGAAACTCAAAGGAATTGACGGGGACCCGCACAAGCGGTGGAGCATG

TGGTTTAATTCGAAGCAACGCGAAGAACCTTACCAGGTCTTGACATCCTTTGAAGCTTTTAGAGATAGAAGTGTTCT

CTTCGGAGACAAAGTGACAGGTGGTGCATGGTCGTCGTCAGCTCGTGTCGTGAGATGTTGGGTTAAGTCCCGCAACG

AGCGCAACCCTTATTGTTAGTTGCCAGCATTCAGATGGGCACTCTAGCGAGACTGCCGGTGATAAACCGGAGGAAGG

CGGGGACGACGTCAGATCATCATGCCCCTTATGACCTGGGCTACACACGTGCTACAATGGCGTATACAACGAGTTGC

CAACCCGCGAGGGTGAGCTAATCTCTTAAAGTACGTCTCAGTTCGGATTGTAGTCTGCAACTCGACTACATGAAGTC

GGAATCGCTAGTAATCGCGGATCAGCACGCCGCGGTGAATACGTTCCCGGGTCTTGTACACACCGCCCGTCACACCA

TGGGAGTTTGTAATGCCCAAAGCCGGTGGCCTAACCTTTTAGGAAGGAGCCGTCTAAGGCAGGACAG

The bacterial strain comprising a 16S rDNA sequence provided by SEQ ID NO: 7 (also referred to herein as "Strain 7") has the highest homology with a bacterial strain of the species *Lactobacillus acidophilus*:

Strain 7 16S ribosomal RNA coding sequence (16S rDNA)

(SEQ ID NO: 7)

TCCTGGCTCAGGACGAACGCTGGCGGCGTGCCTAATACATGCAAGTCGAGCGAGCTGAACCAACAGATTCACTTCGG

TGATGACGTTGGGAACGCGAGCGGCGGATGGGTGAGTAACACGTGGGAACCTGCCCCATAGTCTGGGATACCACTT

GGAAACAGGTGCTAATACCGGATAAGAAAGCAGATCGCATGATCAGCTTATAAAAGGCGGCGTAAGCTGTCGCTATG

GGATGGCCCCGCGGTGCATTAGCTAGTTGGTAGGGTAACGGCCTACCAAGGCAATGATGCATAGCCGAGTTGAGAGA

CTGATCGGCCACATTGGGACTGAGACACGGCCCAAACTCCTACGGGAGGCAGCAGTAGGGAATCTTCCACAATGGAC

-continued

```
GAAAGTCTGATGGAGCAACGCCGCGTGAGTGAAGAAGGTTTTCGGATCGTAAAGCTCTGTTGTTGGTGAAGAAGGAT

AGAGGTAGTAACTGGCCTTTATTTGACGGTAATCAACCAGAAAGTCACGGCTAACTACGTGCCAGCAGCCGCGGTAA

TACGTAGGTGGCAAGCGTTGTCCGGATTTATTGGGCGTAAAGCGAGCGCAGGCGGAAGAATAAGTCTGATGTGAAAG

CCCTCGGCTTAACCGAGGAACTGCATCGGAAACTGTTTTTCTTGAGTGCAGAAGAGGAGAGTGGAACTCCATGTGTA

GCGGTGGAATGCGTAGATATATGGAAGAACACCAGTGGCGAAGGCGGCTCTCTGGTCTGCAACTGACGCTGAGGCTC

GAAAGCATGGGTAGCGAACAGGATTAGATACCCTGGTAGTCCATGCCGTAAACGATGAGTGCTAAGTGTTGGGAGGT

TTCCGCCTCTCAGTGCTGCAGCTAACGCATTAAGCACTCCGCCTGGGGAGTACGACCGCAAGGTTGAAACTCAAAGG

AATTGACGGGGGCCCGCACAAGCGGTGGAGCATGTGGTTTAATTCGAAGCAACGCGAAGAACCTTACCAGGTCTTGA

CATCTAGTGCAATCCGTAGAGATACGGAGTTCCCTTCGGGGACACTAAGACAGGTGGTGCATGGCTGTCGTCAGCTC

GTGTCGTGAGATGTTGGGTTAAGTCCCGCAACGAGCGCAACCCTTGTCATTAGTTGCCAGCATTAAGTTGGGCACTC

TAATGAGACTGCCGGTGACAAACCGGAGGAAGGTGGGGATGACGTCAAGTCATCATGCCCCTTATGACCTGGGCTAC

ACACGTGCTACAATGGACAGTACAACGAGGAGCAAGCCTGCGAAGGCAAGCGAATCTCTTAAAGCTGTTCTCAGTTC

GGACTGCAGTCTGCAACTCGACTGCACGAAGCTGGAATCGCTAGTAATCGCGGATCAGCACGCCGCGGTGAATACGT

TCCCGGGCCTTGTACACACCGCCCGTCACACCATGGGAGTCTGCAATGCCCAAAGCCGGTGGCCTAACCTTCGGGAA

GGAGCCGTCTAAGGC
```

The bacterial strain comprising a 16S rDNA sequence provided by SEQ ID NO: 8 (also referred to herein as "Strain 8") has the highest homology with a bacterial strain of the species *Enterococcus faecium*:

```
Strain 8 16S ribosomal RNA coding sequence (16S rDNA)
                                                        (SEQ ID NO: 8)
AGAGTTTGATCCTGGCTCAGGACGAACGCTGGCGGCGTGCCTATACATGCAAGTCGAACGCTTCTTTTTCCACCGGA

GCTTGCTCCACCGGAAAAAGAGGAGTGGCGAACGGGTGAGTAACACGTGGGTAACCTGCCCATCAGAAAGGGATAAC

ACTTGGAAACAGGTGCTAATACCGTATAACAAATCAAAACCGCATGGTTTTGATTTGAAAGGCGCTTTCGGGTGTCG

CTGATGGATGGACCCGCGGTGCATTAGCTAGTTGGTGAGGTAACGGCTCACCAAGGCCACGATGCATAGCCGCACCT

GAGAGGGTGATCGGCCACATTGGGACTGAGACACGGCCCAAACTCTACGGGAGGCAGCAGTAGGGAATCTTCGGCAA

TGGACGAAAGTCTGACCGAGCAACGCCGCGTGAGTGAAGAAGGTTTTCGGATCGTAAAACTCTGTTGTTAGAGAAGA

ACAAGGATGAGAGTAACTGTTCATCCCTTGACGGTATCTAACCAGAAAGCCACGGCTAACTACGTGCCAGCAGCCGC

GGTAATACGTAGGTGGCAAGCGTTGTCCGGATTTATTGGGCGTAAAGCGAGCGCAGGCGGTTCTTAAGTCTGATGTG

AAAGCCCCCGGCTCAACCGGGGAGGGTCATTGGAAACTGGGAGACTTGAGTGCAGAAGAGGAGAGTGGAATTCCATG

TGTAGCGGTGAAATGCGTAGATATATGGAGGAACACCAGTGGCGAAGGCGGCTCTCTGGTCTGTAACTGACGCTGAG

GCTCGAAAGCGTGGGGAGCAAACAGGATTAGATACCCTGGTAGTCCACGCCGTAAACGATGAGTGCTAAGTGTTGGA

GGGTTTCCGCCCTTCAGTGCTGCAGCTAACGCATTAAGCACTCCGCCTGGGGAGTACGACCGCAAGGTTGAAACTCA

AAGGAATTGACGGGGGCCCGCACAAGCGGTGGAGCATGTGGTTTAATTCGAAGCAACACGAAGAACCTTACCAGGTC

TTGACATCCTTTGACCACTCTAGAGATAGAGCTTCCCCTTCGGGGGCAAAGTGACAGGTGGTGCATGGTTGTCGTCA

GCTCGTGTCGTGAGATGTTGGGTTAAGTCCCGCAACGAGCGCAACCCTTATTGTTAGTTGCCATCATTCAGTTGGGC

ACTCTAGCAAGACTGCCGGTGACAAACCGGAGGAAGGTGGGGATGACGTCAAATCATCATGCCCCTTATGACCTGGG

CTACACACGTGCTACAATGGGAAGTACAACGAGTTGCGAAGTCGCGAGGCTAAGCTAATCTCTTAAAGCTTCTCTCA

GTTCGGATTGCAGGCTGCAACTCGCCTGCATGAAGCCGGAATCGCTAGTAATCGCGGATCAGCACGCCGCGTGAATA

CGTTCCCGGGCCTTGTACACACCGCCCGTCACACCACGAGAGTTTGTAACACCCGAAGTCGGTGAGGTAACCTTTTG

GAGCCAGCCGCCTAAGGTGGGATAGATGATTGGGGTGAAGTCGTAACAAGGTAGCCGTATCTGAAGGTGCGGCTGGA

TCACCTCCTTT
```

The bacterial strain comprising a 16S rDNA sequence provided by SEQ ID NO: 9 (also referred to herein as "Strain 9") has the highest homology with a bacterial strain of the species *Bacillus subtilis*:

```
Strain 9 16S ribosomal RNA coding sequence (16S rDNA)
                                                        (SEQ ID NO: 9)
TTTGATCCTGGCTCAGGACGAACGCTGGCGGCGTGCCTAATACATGCAAGTCGAGCGGACAGATGGGAGCTTGCTCC

CTGATGTTAGCGGCGGACGGGTGAGTAACACGTGGGTAACCTGCCTGTAAGACTGGGATAACTCCGGGAAACCGGGG

CTAATACCGGATGCTTGTTTGAACCGCATGGTTCAAACATAAAAGGTGGCTTCGGCTACCACTTACAGATGGACCCG

CGGCGCATTAGCTAGTTGGTGAGGTAACGGCTCACCAAGGCAACGATGCGTAGCCGACCTGAGAGGGTGATCGGCCA

CACTGGGACTGAGACACGGCCCAGACTCCTACGGGAGGCAGCAGTAGGGAATCTTCCGCAATGGACGAAAGTCTGAC

GGAGCAACGCCGCGTGAGTGATGAAGGTTTTCGGATCGTAAAGCTCTGTTGTTAGGGAAGAACAAGTACCGTTCGAA

TAGGGCGGTACCTTGACGGTACCTAACCAGAAAGCCACGGCTAACTACGTGCCAGCAGCCGCGGTAATACGTAGGTG

GCAAGCGTTGTCCGGAATTATTGGGCGTAAAGGGCTCGCAGGCGGTTTCTTAAGTCTGATGTGAAAGCCCCCGGCTC

AACCGGGGAGGGTCATTGGAAACTGGGGAACTTGAGTGCAGAAGAGGAGAGTGGAATTCCACGTGTAGCGGTGAAAT

GCGTAGAGATGTGGAGGAACACCAGTGGCGAAGGCGACTCTCTGGTCTGTAACTGACGCTGAGGAGCGAAAGCGTGG

GGAGCGAACAGGATTAGATACCCTGGTAGTCCACGCCGTAAACGATGAGTGCTAAGTGTTAGGGGGTTTCCGCCCCT

TAGTGCTGCAGCTAACGCATTAAGCACTCCGCCTGGGGAGTACGGTCGCAAGACTGAAACTCAAAGGAATTGACGGG

GGCCCGCACAAGCGGTGGAGCATGTGGTTTAATTCGAAGCAACGCGAAGAACCTTACCAGGTCTTGACATCCTCTGA

CAATCCTAGAGATAGGACGTCCCCTTCGGGGGCAGAGTGACAGGTGGTGCATGGTTGTCGTCAGCTCGTGTCGTGAG

ATGTTGGGTTAAGTCCCGCAACGAGCGCAACCCTTGATCTTAGTTGCCAGCATTCAGTTGGGCACTCTAAGGTGACT

GCCGGTGACAAACCGGAGGAAGGTGGGGATGACGTCAAATCATCATGCCCCTTATGACCTGGGCTACACACGTGCTA

CAATGGACAGAACAAAGGGCAGCGAAACCGCGAGGTTAAGCCAATCCCACAAATCTGTTCTCAGTTCGGATCGCAGT

CTGCAACTCGACTGCGTGAAGCTGGAATCGCTAGTAATCGCGGATCAGCATGCCGCGGTGAATACGTTCCCGGGCCT

TGTACACACCGCCCGTCACACCACGAGAGTTTGTAACACCCGAAGTCGGTGAGGTAACCTTTTAGGAGCCAGCCGCC

GAAGGTGGGACAGATGATTGGGGTGAAGTCGTAACAAGGTAGCCGTATCGGAAGGTGCGGCTGGATCACCTCCTT
```

The bacterial strain comprising a 16S rDNA sequence provided by SEQ ID NO: 10 (also referred to herein as "Strain 10") has the highest homology with a bacterial strain of the species *Bacillus pumilus*:

```
Strain 10 16S ribosomal RNA coding sequence (16S rDNA)
                                                       (SEQ ID NO: 10)
TGCAGTCGAGCGGACAGAAGGGAGCTTGCTCCCGGATGTTAGCGGCGGACGGGTGAGTAACACGTGGGTAACCTGCC

TGTAAGACTGGGATAACTCCGGGAAACCGGAGCTAATACCGGATAGTTCCTTGAACCGCATGGTTCAAGGATGAAAG

ACGGTTTCGGCTGTCACTTACAGATGGACCCGCGGCGCATTAGCTAGTTGGTGGGGTAATGGCTCACCAAGGCGACG

ATGCGTAGCCGACCTGAGAGGGTGATCGGCCACACTGGGACTGAGACACGGCCCAGACTCCTACGGGAGGCAGCAGT

AGGGAATCTTCCGCAATGGACGAAAGTCTGACGGAGCAACGCCGCGTGAGTGATGAAGGTTTTCGGATCGTAAAGCT

CTGTTGTTAGGGAAGAACAAGTGCGAGAGTAACTGCTCGCACCTTGACGGTACCTAACCAGAAAGCCACGGCTAACT

ACGTGCCAGCAGCCGCGGTAATACGTAGGTGGCAAGCGTTGTCCGGAATTATTGGGCGTAAAGGGCTCGCAGGCGGT

TTCTTAAGTCTGATGTGAAAGCCCCCGGCTCAACCGGGGAGGGTCATTGGAAACTGGGAAACTTGAGTGCAGAAGAG

GAGAGTGGAATTCCACGTGTAGCGGTGAAATGCGTAGAGATGTGGAGGAACACCAGTGGCGAAGGCGACTCTCTGGT

CTGTAACTGACGCTGAGGAGCGAAAGCGTGGGGAGCGAACAGGATTAGATACCCTGGTAGTCCACGCCGTAAACGAT

GAGTGCTAAGTGTTAGGGGGTTTCCGCCCCTTAGTGCTGCAGCTAACGCATTAAGCACTCCGCCTGGGGAGTACGGT

CGCAAGACTGAAACTCAAAGGAATTGACGGGGGCCCGCACAAGCGGTGGAGCATGTGGTTTAATTCGAAGCAACGCG

AAGAACCTTACCAGGTCTTGACATCCTCTGACAACCCTAGAGATAGGGCTTTCCCTTCGGGGACAGAGTGACAGGTG
```

```
                              -continued
GTGCATGGTTGTCGTCAGCTCGTGTCGTGAGATGTTGGGTTAAGTCCCGCAACGAGCGCAACCCTTGATCTTAGTTG

CCAGCATTTAGTTGGGCACTCTAAGGTGACTGCCGGTGACAAACCGGAGGAAGGTGGGGATGACGTCAAATCATCAT

GCCCCTTATGACCTGGGCTACACACGTGCTACAATGGACAGAACAAAGGGCTGCGAGACCGCAAGGTTTAGCCAATC

CCATAAATCTGTTCTCAGTTCGGATCGCAGTCTGCAACTCGACTGCGTGAAGCTGGAATCGCTAGTAATCGCGGATC

AGCATGCCGCGGTGAATACGTTCCCGGGCCTTGTACACACCGCCCGTCACACCACGAGAGTTTGCAACACCCGAAGT

CGGTGAGGTAACCTTTATGGAGCCAGCCGCCGAAGGTGGGGCAGATGA
```

The bacterial strain comprising a 16S rDNA sequence provided by SEQ ID NO: 11 (also referred to herein as "Strain 11") has the highest homology with a bacterial strain of the species *Bacillus licheniformis*:

```
Strain 11 16S ribosomal RNA coding sequence (16S rDNA)
                                                       (SEQ ID NO: 11)
GAGTTTGATCCTGGCTCAGGACGAACGCTGGCGGCGTGCCTAATACATGCAAGTCGAGCGGACCGACGGGAGCTTGC

TCCCTTAGGTCAGCGGCGGACGGGTGAGTAACACGTGGGTAACCTGCCTGTAAGACTGGGATAACTCCGGGAAACCG

GGGCTAATACCGGATGCTTGATTGAACCGCATGGTTCCAATCATAAAAGGTGGCTTTCAGCTACCACTTACAGATGG

ACCCGCGGCGCATTAGCTAGTTGGTGAGGTAACGGCTCACCAAGGCGACGATGCGTAGCCGACCTGAGAGGGTGATC

GGCCACACTGGGACTGAGACACGGCCCAGACTCCTACGGGAGGCAGCAGTAGGGAATCTTCCGCAATGGACGAAAGT

CTGACGGAGCAACGCCGCGTGAGTGATGAAGGTTTTCGGATCGTAAAACTCTGTTGTTAGGGAAGAACAAGTACCGT

TCGAATAGGGCGGCACCTTGACGGTACCTAACCAGAAAGCCACGGCTAACTACGTGCCAGCAGCCGCGGTAATACGT

AGGTGGCAAGCGTTGTCCGGAATTATTGGGCGTAAAGCGCGCGCAGGCGGTTTCTTAAGTCTGATGTGAAAGCCCCC

GGCTCAACCGGGGAGGGTCATTGGAAACTGGGGAACTTGAGTGCAGAAGAGGAGAGTGGAATTCCACGTGTAGCGGT

GAAATGCGTAGAGATGTGGAGGAACACCAGTGGCGAAGGCGACTCTCTGGTCTGTAACTGACGCTGAGGCGCGAAAG

CGTGGGGAGCGAACAGGATTAGATACCCTGGTAGTCCACGCCGTAAACGATGAGTGCTAAGTGTTAGAGGGTTTCCG

CCCTTTAGTGCTGCAGCAAACGCATTAAGCACTCCGCCTGGGGAGTACGGTCGCAAGACTGAAACTCAAAGGAATTG

ACGGGGGCCCGCACAAGCGGTGGAGCATGTGGTTTAATTCGAAGCAACGCGAAGAACCTTACCAGGTCTTGACATCC

TCTGACAACCCTAGAGATAGGGCTTCCCCTTCGGGGGCAGAGTGACAGGTGGTGCATGGTTGTCGTCAGCTCGTGTC

GTGAGATGTTGGGTTAAGTCCCGCAACGAGCGCAACCCTTGATCTTAGTTGCCAGCATTCAGTTGGGCACTCTAAGG

TGACTGCCGGTGACAAACCGGAGGAAGGTGGGGATGACGTCAAATCATCATGCCCCTTATGACCTGGGCTACACACG

TGCTACAATGGGCAGAACAAAGGGCAGCGAAGCCGCGAGGCTAAGCCAATCCCACAAATCTGTTCTCAGTTCGGATC

GCAGTCTGCAACTCGACTGCGTGAAGCTGGAATCGCTAGTAATCGCGGATCAGCATGCCGCGGTGAATACGTTCCCG

GGCCTTGTACACACCGCCCGTCACACCACGAGAGTTTGTAACACCCGAAGTCGGTGAGGTAACCTTTTGGAGCCAGC

CGCCGAAGGTGGGACAGATGATTGGGGTGAAGTCGTAACAAGGTAGCCGTATCGGAAGGTGCGGCTGGATCACCTCC

TTTCTA
```

The bacterial strain comprising a 16S rDNA sequence provided by SEQ ID NO: 12 (also referred to herein as "Strain 12") has the highest homology with a bacterial strain of the species *Bacillus amyloliquefaciens*:

```
Strain 12 16S ribosomal RNA coding sequence (16S rDNA)
                                                       (SEQ ID NO: 12)
CTATCGGAGAGTTTGATCCTGGCTCAGGACGAACGCTGGCGGCGTGCCTAATACATGCAAGTCGAGCGGACAGATGG

GAGCTTGCTCCCTGATGTTAGCGGCGGACGGGTGAGTAACACGTGGGTAACCTGCCTGTAAGACTGGGATAACTCCG

GGAAACCGGGGCTAATACCGGATGCTTGTTTGAACCGCATGGTTCAAACATAAAAGGTGGCTTCGGCTACCACTTAC

AGATGGACCCGCGGCGCATTAGCTAGTTGGTGAGGTAACGGCTCACCAAGGCGACGATGCGTAGCCGACCTGAGAGG

GTGATCGGCCACACTGGGACTGAGACACGGCCCAGACTCCTACGGGAGGCAGCAGTAGGGAATCTTCCGCAATGGAC
```

-continued

```
GAAAGTCTGACGGAGCAACGCCGCGTGAGTGATGAAGGTTTTCGGATCGTAAAGCTCTGTTGTTAGGGAAGAACAAG

TGCCGTTCAAATAGGGCGGCACCTTGACGGTACCTAACCAGAAAGCCACGGCTAACTACGTGCCAGCAGCCGCGGTA

ATACGTAGGTGGCAAGCGTTGTCCGGAATTATTGGGCGTAAAGGGCTCGCAGGCGGTTTCTTAAGTCTGATGTGAAA

GCCCCCGGCTCAACCGGGGAGGGTCATTGGAAACTGGGGAACTTGAGTGCAGAAGAGGAGAGTGGAATTCCACGTGT

AGCGGTGAAATGCGTAGAGATGTGGAGGAACACCAGTGGCGAAGGCGACTCTCTGGTCTGTAACTGACGCTGAGGAG

CGAAAGCGTGGGGAGCGAACAGGATTAGATACCCTGGTAGTCCACGCCGTAAACGATGAGTGCTAAGTGTTAGGGGG

TTTCCGCCCCTTAGTGCTGCAGCTAACGCATTAAGCACTCCGCCTGGGGAGTACGGTCGCAAGACTGAAACTCAAAG

GAATTGACGGGGGCCCGCACAAGCGGTGGAGCATGTGGTTTAATTCGAAGCAACGCGAAGAACCTTACCAGGTCTTG

ACATCCTCTGACAATCCTAGAGATAGGACGTCCCCTTCGGGGGCAGAGTGACAGGTGGTGCATGGTTGTCGTCAGCT

CGTGTCGTGAGATGTTGGGTTAAGTCCCGCAACGAGCGCAACCCTTGATCTTAGTTGCCAGCATTCAGTTGGGCACT

CTAAGGTGACTGCCGGTGACAAACCGGAGGAAGGTGGGGATGACGTCAAATCATCATGCCCCTTATGACCTGGGCTA

CACACGTGCTACAATGGGCAGAACAAAGGGCAGCGAAACCGCGAGGTTAAGCCAATCCCACAAATCTGTTCTCAGTT

CGGATCGCAGTCTGCAACTCGACTGCGTGAAGCTGGAATCGCTAGTAATCGCGGATCAGCATGCCGCGGTGAATACG

TTCCCGGGCCTTGTACACACCGCCCGTCACACCACGAGAGTTTGTAACACCCGAAGTCGGTGAGGTAACCTTTTTGG

AGCCAGCCGCCGAAGGTGGGACAGATGATTGGGGTGAAGTCGTAACAAGGTAGCCGTATCGGAAGGTGCGGCTGGAT

CACCTCCTTT
```

The bacterial strain comprising a 16S rDNA sequence provided by SEQ ID NO: 13 (also referred to herein as "Strain 13") has the highest homology with a bacterial strain of the species *Weizmannia coagulans*, also referred to as *Bacillus coagulans*:

Strain 13 16S ribosomal RNA coding sequence (16S rDNA)

(SEQ ID NO: 13)

```
TGGAGAGTTTGATCCTGGCTCAGGACGAACGCTGGCGGCGTGCCTAATACATGCAAGTCGTGCGGACCTTTTAAAAG

CTTGCTTTTAAAAGGTTAGCGGCGGACGGGTGAGTAACACGTGGGCAACCTGCCTGTAAGACTGGGATAACGCCGGG

AAACCGGGGCTAATACCRGATAGTTTTTTCCTCCGCATGGAGGAAAAAGGAAAGGCGGCTTCGGCTGCCACTTACAG

ATGGGCCCGCGGCGCATTAGCTAGTTGGCGGGGTAACRGCCCACCAAGGCAACGATGCGTAGCCGACCTGAGAGGGT

GATCGGCCACATTGGGACTGAGACACGGCCCAAACTCCTACGGGAGGCAGCAGTAGGGAATCTTCCGCAATGGACGA

AAGTCTGACGGAGCAACGCCGCGTGAGTGAAGAAGGCCTTCGGGTCGTAAAACTCTGTTGCCGGGGAAGAACAAGTG

CCGTTCGAACAGGGCGGCGCCTTGACGGTACCCGGCCAGAAAGCCACGGCTAACTACGTGCCAGCAGCCGCGGTAAT

ACGTAGGTGGCAAGCGTTGTCCGGAATTATTGGGCGTAAAGCGCGCGCAGGCGGCTTCTTAAGTCTGATGTGAAATC

TTGCGGCTCAACCGCAAGCGGTCATTGGAAACTGGGAGGCTTGAGTGCAGAAGAGGAGAGTGGAATTCCACGTGTAG

CGGTGAAATGCGTAGAGATGTGGAGGAACACCAGTGGCGAAGGCGGCTCTCTGGTCTGTAACTGACGCTGAGGCGCG

AAAGCGTGGGGAGCAAACAGGATTAGATACCCTGGTAGTCCACGCCGTAAACGATGAGTGCTAAGTGTTAGAGGGTT

TCCGCCCTTTAGTGCTGCAGCTAACGCATTAAGCACTCCGCCTGGGGAGTACGGCCGCAAGGCTGAAACTCAAAGGA

ATTGACGGGGGCCCGCACAAGCGGTGGAGCATGTGGTTTAATTCGAAGCAACGCGAAGAACCTTACCAGGTCTTGAC

ATCCTCTGACCTCCCTGGAGACAGGGCCTTCCCCTTCGGGGGACAGAGTGACAGGTGGTGCATGGTTGTCGTCAGCT

CGTGTCGTGAGATGTTGGGTTAAGTCCCGCAACGAGCGCAACCCTTGACCTTAGTTGCCAGCATTGAGTTGGGCACT

CTAAGGTGACTGCCGGTGACAAACCGGAGGAAGGTGGGGATGACGTCAAATCATCATGCCCCTTATGACCTGGGCTA

CACACGTGCTACAATGGATGGTACAAAGGGCTGCGAGACCGCGAGGTTAAGCCAATCCCAGAAAACCATTCCCAGTT

CGGATTGCAGGCTGCAACCCGCCTGCATGAAGCCGGAATCGCTAGTAATCGCGGATCAGCATGCCGCGGTGAATACG

TTCCCGGGCCTTGTACACACCGCCCGTCACACCACGAGAGTTTGTAACACCCGAAGTCGGTGAGGTAACCTTTACGG
```

-continued

```
AGCCAGCCGCCGAAGGTGGGACAGATGATTGGGGTGAAGTCGTAACAAGGTAGCCGTATCGGAAGGTGCGGYTGGAT

CACCTCCTT
```

The bacterial strain comprising a 16S rDNA sequence provided by SEQ ID NO: 14 (also referred to herein as "Strain 14") has the highest homology with a bacterial strain of the species *Weissella cibaria*:

```
Strain 14 16S ribosomal RNA coding sequence (16S rDNA)
                                                    (SEQ ID NO: 14)
GATGAACGCTGGCGGCGTGCCTAATACATGCAAGTCGAACGCTTTGTGGTTCAACTGATTTGAAGAGCTTGCTCAGA

TATGACGATGGACATTGCAAAGAGTGGCGAACGGGTGAGTAACACGTGGGAAACCTACCTCTTAGCAGGGGATAACA

TTTGGAAACAGATGCTAATACCGTATAACAATAGCAACCGCATGGTTGCTACTTAAAAGATGGTTCTGCTATCACTA

AGAGATGGTCCCGCGGTGCATTAGTTAGTTGGTGAGGTAATGGCTCACCAAGACGATGATGCATAGCCGAGTTGAGA

GACTGATCGGCCACAATGGGACTGAGACACGGCCCATACTCCTACGGGAGGCAGCAGTAGGGAATCTTCCACAATGG

GCGAAAGCCTGATGGAGCAACGCCGCGTGTGTGATGAAGGGTTTCGGCTCGTAAAACACTGTTGTAAGAGAAGAATG

ACATTGAGAGTAACTGTTCAATGTGTGACGGTATCTTACCAGAAAGGAACGGCTAAATACGTGCCAGCAGCCGCGGT

AATACGTATGTTCCAAGCGTTATCCGGATTTATTGGGCGTAAAGCGAGCGCAGACGGTTATTTAAGTCTGAAGTGAA

AGCCCTCAGCTCAACTGAGGAATTGCTTTGGAAACTGGATGACTTGAGTGCAGTAGAGGAAAGTGGAACTCCATGTG

TAGCGGTGAAATGCGTAGATATATGGAAGAACACCAGTGGCGAAGGCGGCTTTCTGGACTGTAACTGACGTTGAGGC

TCGAAAGTGTGGGTAGCAAACAGGATTAGATACCCTGGTAGTCCACACCGTAAACGATGAGTGCTAGGTGTTTGAGG

GTTTCCGCCCTTAAGTGCCGCAGCTAACGCATTAAGCACTCCGCCTGGGGAGTACGACCGCAAGGTTGAAACTCAAA

GGAATTGACGGGGACCCGCACAAGCGGTGGAGCATGTGGTTTAATTCGAAGCAACGCGAAGAACCTTACCAGGTCTT

GACATCCCTTGACAACTCCAGAGATGGAGCGTTCCCTTCGGGGACAAGGTGACAGGTGGTGCATGGTTGTCRTCAGC

TCGTGTCGTGAGATGTTGGGTTAAGTCCCGCAACRAGCGCAACCCTTATTACTAGTTGCCAGCATTYAGTTGGGCAC

TCTAGTGAGACTGCCGGTGACAAACCGGAGGAAGGTGGGGATGACGTCAAATCATCATGCCCCTTATGACCTGGGCT

ACACACGTGCTACAATGGCGTATACAACGAGTTGCCAACCCGCGAGGGTGAGCTAATCTCTTAAAGTACGTCTCAGT

TCGGATTGTAGGCTGCAACTCGCCTACATGAAGTCGGAATCGCTAGTAATCGCGGATCAGCACGCCGCGGTGAATAC

GTTCCCGGGTCTTGTACACACCGCCCGTCACACCATGAGAGTTTGTAACACCCAAAGCCGGTGGGGTAACCTTCGGG

AGCCAGCCGTCTAAGGTGGGACAGATGATTAGGGTGAAGTCGTAACAAGGTAGCCGTAGGAGAACC
```

The bacterial strain comprising a 16S rDNA sequence provided by SEQ ID NO: 15 (also referred to herein as "Strain 15") has the highest homology with a bacterial strain of the species *Streptococcus salivarius*:

```
Strain 15 16S ribosomal RNA coding sequence (16S rDNA)
                                                    (SEQ ID NO: 15)
ATGGGAGAGTTTGATCCTGGCTCAGGACGAACGCTGGCGGCGTGCCTAATACATGCAAGTAGAACGCTGAAGAGAGG

AGCTTGCTCTTCTTGGATGAGTTGCGAACGGGTGAGTAACGCGTAGGTAACCTGCCTTGTAGCGGGGGATAACTATT

GGAAACGATAGCTAATACCGCATAACAATGGATGACACATGTCATTTATTTGAAAGGGGCAATTGCTCCACTACAAG

ATGGACCTGCGTTGTATTAGCTAGTAGGTGAGGTAATGGCTCACCTAGGCGACGATACATAGCCGACCTGAGAGGGT

GATCGGCCACACTGGGACTGAGACACGGCCCAGACTCCTACGGGAGGCAGCAGTAGGGAATCTTCGGCAATGGGGGC

AACCCTGACCGAGCAACGCCGCGTGAGTGAAGAAGGTTTTCGGATCGTAAAGCTCTGTTGTAAGTCAAGAACGGGTG

TGAGAGTGGAAAGTTCACACTGTGACGGTAGCTTACCAGAAAGGGACGGCTAACTACGTGCCAGCAGCCGCGGTAAT

ACGTAGGTCCCGAGCGTTGTCCGGATTTATTGGGCGTAAAGCGAGCGCAGGCGGTTTGATAAGTCTGAAGTTAAAGG

CTGTGGCTCAACCATAGTTCGCTTTGGAAACTGTCAAACTTGAGTGCAGAAGGGGAGAGTGGAATTCCATGTGTAGC

GGTGAAATGCGTAGATATATGGAGGAACACCGGTGGCGAAAGCGGCTCTCTGGTCTGTAACTGACGCTGAGGCTCGA
```

```
AAGCGTGGGGAGCGAACAGGATTAGATACCCTGGTAGTCCACGCCGTAAACGATGAGTGCTAGGTGTTGGATCCTTT

CCGGGATTCAGTGCCGCAGCTAACGCATTAAGCACTCCGCCTGGGGAGTACGACCGCAAGGTTGAAACTCAAAGGAA

TTGACGGGGGCCCGCACAAGCGGTGGAGCATGTGGTTTAATTCGAAGCAACGCGAAGAACCTTACCAGGTCTTGACA

TCCCGATGCTATTTCTAGAGATAGAAAGTTACTTCGGTACATCGGTGACAGGTGGTGCATGGTTGTCGTCAGCTCGT

GTCGTGAGATGTTGGGTTAAGTCCCGCAACGAGCGCAACCCCTATTGTTAGTTGCCATCATTCAGTTGGGCACTCTA

GCGAGACTGCCGGTAATAAACCGGAGGAAGGTGGGGATGACGTCAAATCATCATGCCCCTTATGACCTGGGCTACAC

ACGTGCTACAATGGTTGGTACAACGAGTTGCGAGTCGGTGACGGCGAGCTAATCTCTTAAAGCCAATCTCAGTTCGG

ATTGTAGGCTGCAACTCGCCTACATGAAGTCGGAATCGCTAGTAATCGCGGATCAGCACGCCGCGGTGAATACGTTC

CCGGGCCTTGTACACACCGCCCGTCACACCACGAGAGTTTGTAACACCCGAAGTCGGTGAGGTAACCTTTTGGAGCC

AGCCGCCTAAGGTGGGACAGATGATTGGGGTGAAGTCGTAACAAGGTAGCCGTATCGGAAGGTGCGGCTGGATCAC
```

The bacterial strain comprising a 16S rDNA sequence provided by SEQ ID NO: 16 (also referred to herein as "Strain 16") has the highest homology with a bacterial strain of the species *Lactococcus lactis*:

Strain 16 16S ribosomal RNA coding sequence (16S rDNA)

(SEQ ID NO: 16)
```
GACGAACGCTGGCGGCGTGCCTAATACATGCAAGTTGAGCGCTGAAGGTTGGTACTTGTACCGACTGGATGAGCAGC

GAACGGGTGAGTAACGCGTGGGGAATCTGCCTTTGAGCGGGGGACAACATTTGGAAACGAATGCTAATACCGCATAA

AAACTTTAAACACAAGTTTTAAGTTTGAAAGATGCAATTGCATCACTCAAAGATGATCCCGCGTTGTATTAGCTAGT

TGGTGAGGTAAAGGCTCACCAAGGCGATGATACATAGCCGACCTGAGAGGGTGATCGGCCACATTGGGACTGAGACA

CGGCCCAAACTCCTACGGGAGGCAGCAGTAGGGAATCTTCGGCAATGGACGAAAGTCTGACCGAGCAACGCCGCGTG

AGTGAAGAAGGTTTTCGGATCGTAAAACTCTGTTGGTAGAGAAGAACGTTGGTGAGAGTGGAAAGCTCATCAAGTGA

CGGTAACTACCCAGAAAGGGACGGCTAACTACGTGCCAGCAGCCGCGGTAATACGTAGGTCCCGAGCGTTGTCCGGA

TTTATTGGGCGTAAAGCGAGCGCAGGTGGTTTATTAAGTCTGGTGTAAAAGGCAGTGGCTCAACCATTGTATGCATT

GGAAACTGGTAGACTTGAGTGCAGGAGAGGAGAGTGGAATTCCATGTGTAGCGGTGAAATGCGTAGATATATGGAGG

AACACCGGTGGCGAAAGCGGCTCTCTGGCCTGTAACTGACACTGAGGCTCGAAAGCGTGGGGAGCAAACAGGATTAG

ATACCCTGGTAGTCCACGCCGTAAACGATGAGTGCTAGATGTAGGGAGCTATAAGTTCTCTGTATCGCAGCTAACGC

AATAAGCACTCCGCCTGGGAGTACGACCGCAAGGTTGAAACTCAAAGGAATTGACGGGGGCCCGCACAAGCGGTGG

AGCATGTGGTTTAATTCGAAGCAACGCGAAGAACCTTACCAGGTCTTGACATACTCGTGCTATTCCTAGAGATAGGA

AGTTCCTTCGGGACACGGGATACAGGTGGTGCATGGTTGTCGTCAGCTCGTGTCGTGAGATGTTGGGTTAAGTCCCG

CAACGAGCGCAACCCCTATTGTTAGTTGCCATCATTAAGTTGGGCACTCTAACGAGACTGCCGGTGATAAACCGGAG

GAAGGTGGGGATGACGTCAAATCATCATGCCCCTTATGACCTGGGCTACACACGTGCTACAATGGATGGTACAACGA

GTCGCGAGACAGTGATGTTTAGCTAATCTCTTAAAACCATTCTCAGTTCGGATTGTAGGCTGCAACTCGCCTACATG

AAGTCGGAATCGCTAGTAATCGCGGATCAGCACGCCGCGGTGAATACGTTCCCGGGCCTTGTACACACCGCCCGTCA

CACCACGGGAGTTGGGAGTACCCGAAGTAGGTTGCCTAACCGCAAGGAGGGCGCTTCCTAAGGTAAGACCGATGACT

GGGGTGAAGTCGTAACAAGGTAGCCGTATCGGAAGG
```

The bacterial strain comprising a 16S rDNA sequence provided by SEQ ID NO: 17 (also referred to herein as "Strain 17") has the highest homology with a bacterial strain of the species *Pediococcus pentosaceus*:

Strain 17 16S ribosomal RNA coding sequence (16S rDNA)

(SEQ ID NO: 17)
```
ATGAGAGTTTGATCTTGGCTCAGGATGAACGCTGGCGGCGTGCCTAATACATGCAAGTCGAACGAACTTCCGTTAAT

TGATTATGACGTACTTGTACTGATTGAGATTTTAACACGAAGTGAGTGGCGAACGGGTGAGTAACACGTGGGTAACC
```

-continued

```
TGCCCAGAAGTAGGGGATAACACCTGGAAACAGATGCTAATACCGTATAACAGAGAAAACCGCATGGTTTTCTTTTA

AAAGATGGCTCTGCTATCACTTCTGGATGGACCCGCGGCGTATTAGCTAGTTGGTGAGGTAAAGGCTCACCAAGGCA

GTGATACGTAGCCGACCTGAGAGGGTAATCGGCCACATTGGGACTGAGACACGGCCCAGACTCCTACGGGAGGCAGC

AGTAGGGAATCTTCCACAATGGACGCAAGTCTGATGGAGCAACGCCGCGTGAGTGAAGAAGGGTTTCGGCTCGTAAA

GCTCTGTTGTTAAAGAAGAACGTGGGTAAGAGTAACTGTTTACCCAGTGACGGTATTTAACCAGAAAGCCACGGCTA

ACTACGTGCCAGCAGCCGCGGTAATACGTAGGTGGCAAGCGTTATCCGGATTTATTGGGCGTAAAGCGAGCGCAGGC

GGTCTTTTAAGTCTAATGTGAAAGCCTTCGGCTCAACCGAAGAAGTGCATTGGAAACTGGGAGACTTGAGTGCAGAA

GAGGACAGTGGAACTCCATGTGTAGCGGTGAAATGCGTAGATATATGGAAGAACACCAGTGGCGAAGGCGGCTGTCT

GGTCTGCAACTGACGCTGAGGCTCGAAAGCATGGGTAGCGAACAGGATTAGATACCCTGGTAGTCCATGCCGTAAAC

GATGATTACTAAGTGTTGGAGGGTTTCCGCCCTTCAGTGCTGCAGCTAACGCATTAAGTAATCCGCCTGGGGAGTAC

GACCGCAAGGTTGAAACTCAAAAGAATTGACGGGGGCCCGCACAAGCGGTGGAGCATGTGGTTTAATTCGAAGCTAC

GCGAAGAACCTTACCAGGTCTTGACATCTTCTGACAGTCTAAGAGATTAGAGGTTCCCTTCGGGGACAGAATGACAG

GTGGTGCATGGTTGTCGTCAGCTCGTGTCGTGAGATGTTGGGTTAAGTCCCGCAACGAGCGCAACCCTTATTACTAG

TTGCCAGCATTAAGTTGGGCACTCTAGTGAGACTGCCGGTGACAAACCGGAGGAAGGTGGGGACGACGTCAAATCAT

CATGCCCCTTATGACCTGGGCTACACACGTGCTACAATGGATGGTACAACGAGTCGCGAGACCGCGAGGTTAAGCTA

ATCTCTTAAAACCATTCTCAGTTCGGACTGTAGGCTGCAACTCGCCTACACGAAGTCGGAATCGCTAGTAATCGCGG

ATCAGCATGCCGCGGTGAATACGTTCCCGGGCCTTGTACACACCGCCCGTCACACCATGAGAGTTTGTAACACCCAA

AGCCGGTGGGGTAACCTTTTAGGAGCTAGCCGTCTAAGGTGGGACAGATGATTAGGGTGAAGTCGTAACAAGGTAGC

CGTAGGAGAACCTGCGGCTGGATCACCTCCTT
```

In some embodiments, the bacterial mixture comprises two or more bacterial strains belonging to the species *Pediococcus pentosaceus*, wherein the bacterial strains belonging to the species *Pediococcus pentosaceus* are different bacterial strains. For example, in some embodiments, one bacterial strain of *Pediococcus pentosaceus* has a raised colony morphology, and a second strain of *Pediococcus pentosaceus* has a flat colony morphology. In some embodiments, a first bacterial strain of *Pediococcus pentosaceus* has a rough surface colony morphology, and a second strain of *Pediococcus pentosaceus* has a smooth surface colony morphology. Such differences in colony morphology are routinely used in the art to distinguish bacterial strains. In some embodiments, the bacterial mixture comprises one bacterial strain belonging to *Pediococcus pentosaceus*. In some embodiments, the bacterial mixture comprises two bacterial strains belonging to *Pediococcus pentosaceus*. In some embodiments, the bacterial mixture comprises 2, 3, 4, 5, 6, 7, 8, 9, or 10 bacterial strains belonging to *Pediococcus pentosaceus*. In some embodiments, a first bacterial strain belonging to *Pediococcus pentosaceus* comprises a 16S rDNA sequence with at least 97% sequence identity to the nucleic acid sequence of SEQ ID NO: 1, and a second bacterial strain belonging to *Pediococcus pentosaceus* comprises a 16S rDNA sequence with at least 97% sequence identity to the nucleic acid sequence of SEQ ID NO: 17, and the 16S rDNA sequences of the first and second bacterial strains belonging to *Pediococcus pentosaceus* are not 100% identical. In some embodiments, the 16S rDNA sequence of the first bacterial strain belonging to *Pediococcus pentosaceus* has no more than 99.9%, 99.8%, 99.7%, 99.6%, 99.5%, 99.4%, 99.3%, 99.2%, 99.1%, 99.0%, 98.8%, 98.6%, 98.5%, 98.4%, 98.2%, 98.0%, 97.8%, 97.6%, 97.5%, 97.4%, or 97.2% identity to 16S rDNA sequence of the second bacterial strain belonging to *Pediococcus pentosaceus*. In some embodiments, each bacterial strain belonging to the species *Pediococcus pentosaceus* comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 18 or 34. In some embodiments, each bacterial strain belonging to the species *Pediococcus pentosaceus* comprises a genome with an AF of at least 65%, 70%, 75%, 80%, 85%, 90%, 91%, 92%, 93%, 94%, 95%, 96%, 97%, 98%, or 99% to the reference genome of SEQ ID NO: 18 or 34.

In some embodiments, the bacterial mixture comprises two or more bacterial strains belonging to the species *Lactiplantibacillus plantarum*, wherein the bacterial strains belonging to the species *Lactiplantibacillus plantarum* are different bacterial strains. For example, in some embodiments, one bacterial strain of *Lactiplantibacillus plantarum* has a raised colony morphology, and a second strain of *Lactiplantibacillus plantarum* has a flat colony morphology. In some embodiments, a first bacterial strain of *Lactiplantibacillus plantarum* has a rough surface colony morphology, and a second strain of *Lactiplantibacillus plantarum* has a smooth surface colony morphology. In some embodiments, a first strain of *Lactiplantibacillus plantarum* produces one or more antioxidants, and a second strain of *Lactiplantibacillus plantarum* (i) produces the one or more antioxidants at lower concentrations, (ii) produces different antioxidants, and/or (iii) does not produce the one or more antioxidants. In some embodiments, a first strain of *Lacti-*

*plantibacillus plantarum* produces one or more antioxidants that the second strain of *Lactiplantibacillus plantarum* does not produce. In some embodiments, a first strain of *Lactiplantibacillus plantarum* produces one or more organic acids that the second strain of *Lactiplantibacillus plantarum* does not produce. In some embodiments, a composition comprises at least two bacterial strains of *Lactiplantibacillus plantarum*, where a first strain of *Lactiplantibacillus plantarum* produces one or more antioxidants that are not produced by the second strain of *Lactiplantibacillus plantarum*, and the second strain of *Lactiplantibacillus plantarum* produces one or more organic acids that are not produced by the first strain of *Lactiplantibacillus plantarum*. Such differences in colony morphology and metabolism (e.g., production of antioxidants and/or organic acids) are used in the art to distinguish bacterial strains. In some embodiments, the bacterial mixture comprises one bacterial strain belonging to *Lactiplantibacillus plantarum*. In some embodiments, the bacterial mixture comprises two bacterial strains belonging to *Lactiplantibacillus plantarum*. In some embodiments, the bacterial mixture comprises 2, 3, 4, 5, 6, 7, 8, 9, or 10 bacterial strains belonging to *Lactiplantibacillus plantarum*. In some embodiments, a first bacterial strain belonging to *Lactiplantibacillus plantarum* comprises a 16S rDNA sequence with at least 97% sequence identity to the nucleic acid sequence of SEQ ID NO: 1, and a second bacterial strain belonging to *Lactiplantibacillus plantarum* comprises a 16S rDNA sequence with at least 97% sequence identity to the nucleic acid sequence of SEQ ID NO: 17, and the 16S rDNA sequences of the first and second bacterial strains belonging to *Lactiplantibacillus plantarum* are not 100% identical. In some embodiments, the 16S rDNA sequence of the first bacterial strain belonging to *Lactiplantibacillus plantarum* has no more than 99.9%, 99.8%, 99.7%, 99.6%, 99.5%, 99.4%, 99.3%, 99.2%, 99.1%, 99.0%, 98.8%, 98.6%, 98.5%, 98.4%, 98.2%, 98.0%, 97.8%, 97.6%, 97.5%, 97.4%, or 97.2% identity to 16S rDNA sequence of the second bacterial strain belonging to *Lactiplantibacillus plantarum*. In some embodiments, each bacterial strain belonging to the species *Lactiplantibacillus plantarum* comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 19 or 20. In some embodiments, each bacterial strain belonging to the species *Lactiplantibacillus plantarum* comprises a genome with an AF of at least 65%, 70%, 75%, 80%, 85%, 90%, 91%, 92%, 93%, 94%, 95%, 96%, 97%, 98%, or 99% to the reference genome of SEQ ID NO: 19 or 20.

Bacterial mixtures of a composition, nutritional supplement, dental supplement, and/or food product may include one or more additional bacterial strains. Additional bacterial strains may be taxonomically or phylogenetically related to bacterial strains of *Pediococcus pentosaceus, Lactiplantibacillus plantarum, Latilactobacillus curvatus, Limosilactobacillus fermentum, Leuconostoc mesenteroides, Lactobacillus acidophilus, Enterococcus faecium, Bacillus subtilis, Bacillus pumilus, Bacillus licheniformis, Bacillus amyloliquefaciens, Weizmannia coagulans, Weissella cibaria,* or *Lactococcus lactis.* In some embodiments, one or more additional bacterial strains belong to the species *Pediococcus pentosaceus.* In some embodiments, one or more additional bacterial strains belong to the species *Lactiplantibacillus plantarum*. In some embodiments, one or more additional bacterial strains belong to the species *Latilactobacillus curvatus*. In some embodiments, one or more additional bacterial strains belong to the species *Limosilactobacillus fermentum*. In some embodiments, one or more additional bacterial strains belong to the species *Leuconostoc mesenteroides*. In some embodiments, one or more additional bacterial strains belong to the species *Lactobacillus acidophilus*. In some embodiments, one or more additional bacterial strains belong to the species *Enterococcus faecium*. In some embodiments, one or more additional bacterial strains belong to the species *Bacillus subtilis*. In some embodiments, one or more additional bacterial strains belong to the species *Bacillus pumilus*. In some embodiments, one or more additional bacterial strains belong to the species *Bacillus licheniformis*. In some embodiments, one or more additional bacterial strains belong to the species *Bacillus amyloliquefaciens*. In some embodiments, one or more additional bacterial strains belong to the species *Weizmannia coagulans*. In some embodiments, one or more additional bacterial strains belong to the species *Weissella cibaria*. In some embodiments, one or more additional bacterial strains belong to the species *Lactococcus lactis.*

In some embodiments, a bacterial mixture comprises 2, 3, 4, 5, 6, 7, 8, 9, 10, 11, 12, 13, 14, 15, 16, 17, 18, 19, or 20 additional bacterial strains belonging to the species *Pediococcus pentosaceus*. In some embodiments, the 16S rDNA sequence of an additional bacterial strain belonging to *Pediococcus pentosaceus* is not identical to SEQ ID NO: 1 or SEQ ID NO: 17. In some embodiments, an additional bacterial strain belonging to *Pediococcus pentosaceus* comprises a 16S rDNA sequence that has at least 97%, but less than 100%, sequence identity to the nucleic acid sequence of SEQ ID NO: 1. In some embodiments, an additional bacterial strain belonging to *Pediococcus pentosaceus* comprises a 16S rDNA sequence that has at least 97%, but less than 100%, sequence identity to the nucleic acid sequence of SEQ ID NO: 17. In some embodiments, each additional bacterial strain belonging to the species *Pediococcus pentosaceus* comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 18 or 34. In some embodiments, each additional bacterial strain belonging to the species *Pediococcus pentosaceus* comprises a genome with an AF of at least 65%, 70%, 75%, 80%, 85%, 90%, 91%, 92%, 93%, 94%, 95%, 96%, 97%, 98%, or 99% to the reference genome of SEQ ID NO: 18 or 34.

In some embodiments, a bacterial mixture comprises 2, 3, 4, 5, 6, 7, 8, 9, 10, 11, 12, 13, 14, 15, 16, 17, 18, 19, or 20 additional bacterial strains belonging to the species *Lactiplantibacillus plantarum*. In some embodiments, the 16S rDNA sequence of an additional bacterial strain belonging to *Lactiplantibacillus plantarum* is not identical to SEQ ID NO: 2 or SEQ ID NO: 3. In some embodiments, an additional bacterial strain belonging to *Lactiplantibacillus plantarum* comprises a 16S rDNA sequence that has at least 97%, but less than 100%, sequence identity to the nucleic acid sequence of SEQ ID NO: 2. In some embodiments, an additional bacterial strain belonging to *Lactiplantibacillus plantarum* comprises a 16S rDNA sequence that has at least 97%, but less than 100%, sequence identity to the nucleic acid sequence of SEQ ID NO: 3. In some embodiments, a bacterial strain comprising a 16S rDNA sequence with at least 97% sequence identity to SEQ ID NO: 2 produces one or more organic acids. In some embodiments, a bacterial strain comprising a 16S rDNA sequence with at least 97% sequence identity to SEQ ID NO: 2 produces a greater amount of acid than a bacterial strain comprising a 16S rDNA sequence with at least 97% sequence identity to SEQ ID NO: 3. In some embodiments, a bacterial strain comprising a 16S rDNA sequence with at least 97% sequence identity to SEQ NO: 3 produces one or more antioxidants. In some embodiments, each additional bacterial strain belonging to the species *Lactiplantibacillus plantarum* comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 19 or 20. In some embodiments, each additional bacterial strain belonging to the species *Lactiplantibacillus plantarum* comprises a genome with an AF of at least 65%, 70%, 75%, 80%, 85%, 90%, 91%, 92%, 93%, 94%, 95%, 96%, 97%, 98%, or 99% to the reference genome of SEQ ID NO: 19 or 20.

In some embodiments, a bacterial mixture comprises 2, 3, 4, 5, 6, 7, 8, 9, 10, 11, 12, 13, 14, 15, 16, 17, 18, 19, or 20 additional bacterial strains belonging to the species *Latilactobacillus curvatus*. In some embodiments, the 16S rDNA sequence of an additional bacterial strain belonging to *Latilactobacillus curvatus* is not identical to SEQ ID NO: 4. In some embodiments, an additional bacterial strain belonging to *Latilactobacillus curvatus* comprises a 16S rDNA sequence that has at least 97%, but less than 100%, sequence identity to the nucleic acid sequence of SEQ ID NO: 4. In some embodiments, each additional bacterial strain belonging to the species *Latilactobacillus curvatus* comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 21. In some embodiments, each additional bacterial strain belonging to the species *Latilactobacillus curvatus* comprises a genome with an AF of at least 65%, 70%, 75%, 80%, 85%, 90%, 91%, 92%, 93%, 94%, 95%, 96%, 97%, 98%, or 99% to the reference genome of SEQ ID NO: 21.

In some embodiments, a bacterial mixture comprises 2, 3, 4, 5, 6, 7, 8, 9, 10, 11, 12, 13, 14, 15, 16, 17, 18, 19, or 20 additional bacterial strains belonging to the species *Limosilactobacillus fermentum*. In some embodiments, the 16S rDNA sequence of an additional bacterial strain belonging to *Limosilactobacillus fermentum* is not identical to SEQ ID NO: 5. In some embodiments, an additional bacterial strain belonging to *Limosilactobacillus fermentum* comprises a 16S rDNA sequence that has at least 97%, but less than 100%, sequence identity to the nucleic acid sequence of SEQ ID NO: 5. In some embodiments, each additional bacterial strain belonging to the species *Limosilactobacillus fermentum* comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 22. In some embodiments, each additional bacterial strain belonging to the species *Limosilactobacillus fermentum* comprises a genome with an AF of at least 65%, 70%, 75%, 80%, 85%, 90%, 91%, 92%, 93%, 94%, 95%, 96%, 97%, 98%, or 99% to the reference genome of SEQ ID NO: 22.

In some embodiments, a bacterial mixture comprises 2, 3, 4, 5, 6, 7, 8, 9, 10, 11, 12, 13, 14, 15, 16, 17, 18, 19, or 20 additional bacterial strains belonging to the species *Leuconostoc mesenteroides*. In some embodiments, the 16S rDNA sequence of an additional bacterial strain belonging to *Leuconostoc mesenteroides* is not identical to SEQ ID NO: 6. In some embodiments, an additional bacterial strain belonging to *Leuconostoc mesenteroides* comprises a 16S rDNA sequence that has at least 97%, but less than 100%, sequence identity to the nucleic acid sequence of SEQ ID NO: 6. In some embodiments, each additional bacterial strain belonging to the species *Leuconostoc mesenteroides* comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 23. In some embodiments, each additional bacterial strain belonging to the species *Leuconostoc mesenteroides* comprises a genome with an AF of at least 65%, 70%, 75%, 80%, 85%, 90%, 91%, 92%, 93%, 94%, 95%, 96%, 97%, 98%, or 99% to the reference genome of SEQ ID NO: 23.

In some embodiments, a bacterial mixture comprises 2, 3, 4, 5, 6, 7, 8, 9, 10, 11, 12, 13, 14, 15, 16, 17, 18, 19, or 20 additional bacterial strains belonging to the species *Lactobacillus acidophilus*. In some embodiments, the 16S rDNA sequence of an additional bacterial strain belonging to *Lactobacillus acidophilus* is not identical to SEQ ID NO: 7. In some embodiments, an additional bacterial strain belonging to *Lactobacillus acidophilus* comprises a 16S rDNA sequence that has at least 97%, but less than 100%, sequence identity to the nucleic acid sequence of SEQ ID NO: 7.

In some embodiments, a bacterial mixture comprises 2, 3, 4, 5, 6, 7, 8, 9, 10, 11, 12, 13, 14, 15, 16, 17, 18, 19, or 20 additional bacterial strains belonging to the species *Enterococcus faecium*. In some embodiments, the 16S rDNA sequence of an additional bacterial strain belonging to *Enterococcus faecium* is not identical to SEQ ID NO: 8. In some embodiments, an additional bacterial strain belonging to *Enterococcus faecium* comprises a 16S rDNA sequence that has at least 97%, but less than 100%, sequence identity to the nucleic acid sequence of SEQ ID NO: 8. In some embodiments, each additional bacterial strain belonging to the species *Enterococcus faecium* comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 25. In some embodiments, each additional bacterial strain belonging to the species *Enterococcus faecium* comprises a genome with an AF of at least 65%, 70%, 75%, 80%, 85%, 90%, 91%, 92%, 93%, 94%, 95%, 96%, 97%, 98%, or 99% to the reference genome of SEQ ID NO: 25.

In some embodiments, a bacterial mixture comprises 2, 3, 4, 5, 6, 7, 8, 9, 10, 11, 12, 13, 14, 15, 16, 17, 18, 19, or 20 additional bacterial strains belonging to the species *Bacillus subtilis. In some embodiments, the* 16S rDNA sequence of an additional bacterial strain belonging to *Bacillus subtilis* is not identical to SEQ ID NO: 9. In some embodiments, an additional bacterial strain belonging to *Bacillus subtilis* comprises a 16S rDNA sequence that has at least 97%, but less than 100%, sequence identity to the nucleic acid sequence of SEQ ID NO: 9. In some embodiments, each additional bacterial strain belonging to the species *Bacillus subtilis* comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 26. In some embodiments, each additional bacterial strain belonging to the species *Bacillus subtilis* comprises a genome with an AF of at least 65%, 70%, 75%, 80%, 85%, 90%, 91%, 92%, 93%, 94%, 95%, 96%, 97%, 98%, or 99% to the reference genome of SEQ ID NO: 26.

In some embodiments, a bacterial mixture comprises 2, 3, 4, 5, 6, 7, 8, 9, 10, 11, 12, 13, 14, 15, 16, 17, 18, 19, or 20 additional bacterial strains belonging to the species *Bacillus pumilus*. In some embodiments, the 16S rDNA sequence of an additional bacterial strain belonging to *Bacillus pumilus* is not identical to SEQ ID NO: 10. In some embodiments, an additional bacterial strain belonging to *Bacillus pumilus* comprises a 16S rDNA sequence that has at least 97%, but less than 100%, sequence identity to the nucleic acid sequence of SEQ ID NO: 10. In some embodiments, each additional bacterial strain belonging to the species *Bacillus pumilus* comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 27. In some embodiments, each additional bacterial strain belonging to the species *Bacillus pumilus* comprises a genome with an AF of at least 65%, 70%, 75%, 80%, 85%, 90%, 91%, 92%, 93%, 94%, 95%, 96%, 97%, 98%, or 99% to the reference genome of SEQ ID NO: 27.

In some embodiments, a bacterial mixture comprises 2, 3, 4, 5, 6, 7, 8, 9, 10, 11, 12, 13, 14, 15, 16, 17, 18, 19, or 20 additional bacterial strains belonging to the species *Bacillus licheniformis*. In some embodiments, the 16S rDNA sequence of an additional bacterial strain belonging to *Bacillus licheniformis* is not identical to SEQ ID NO: 11. In some embodiments, an additional bacterial strain belonging to *Bacillus licheniformis* comprises a 16S rDNA sequence that has at least 97%, but less than 100%, sequence identity to the nucleic acid sequence of SEQ ID NO: 11. In some embodiments, each additional bacterial strain belonging to the species *Bacillus licheniformis* comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 28. In some embodiments, each additional bacterial strain belonging to the species *Bacillus licheniformis* comprises a genome with an AF of at least 65%, 70%, 75%, 80%, 85%, 90%, 91%, 92%, 93%, 94%, 95%, 96%, 97%, 98%, or 99% to the reference genome of SEQ ID NO: 28.

In some embodiments, a bacterial mixture comprises 2, 3, 4, 5, 6, 7, 8, 9, 10, 11, 12, 13, 14, 15, 16, 17, 18, 19, or 20 additional bacterial strains belonging to the species *Bacillus amyloliquefaciens*. In some embodiments, the 16S rDNA sequence of an additional bacterial strain belonging to *Bacillus amyloliquefaciens* is not identical to SEQ ID NO: 12. In some embodiments, an additional bacterial strain belonging to *Bacillus amyloliquefaciens* comprises a 16S rDNA sequence that has at least 97%, but less than 100%, sequence identity to the nucleic acid sequence of SEQ ID NO: 12. In some embodiments, each additional bacterial strain belonging to the species *Bacillus amyloliquefaciens* comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 29. In some embodiments, each additional bacterial strain belonging to the species *Bacillus amyloliquefaciens* comprises a genome with an AF of at least 65%, 70%, 75%, 80%, 85%, 90%, 91%, 92%, 93%, 94%, 95%, 96%, 97%, 98%, or 99% to the reference genome of SEQ ID NO: 29.

In some embodiments, a bacterial mixture comprises 2, 3, 4, 5, 6, 7, 8, 9, 10, 11, 12, 13, 14, 15, 16, 17, 18, 19, or 20 additional bacterial strains belonging to the species *Weizmannia coagulans*. In some embodiments, the 16S rDNA sequence of an additional bacterial strain belonging to *Weizmannia coagulans* is not identical to SEQ ID NO: 13. In some embodiments, an additional bacterial strain belonging to *Weizmannia coagulans* comprises a 16S rDNA sequence that has at least 97%, but less than 100%, sequence identity to the nucleic acid sequence of SEQ ID NO: 13. In some embodiments, each additional bacterial strain belonging to the species *Weizmannia coagulans* comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 30. In some embodiments, each additional bacterial strain belonging to the species *Weizmannia coagulans* comprises a genome with an AF of at least 65%, 70%, 75%, 80%, 85%, 90%, 91%, 92%, 93%, 94%, 95%, 96%, 97%, 98%, or 99% to the reference genome of SEQ ID NO: 30.

In some embodiments, a bacterial mixture comprises 2, 3, 4, 5, 6, 7, 8, 9, 10, 11, 12, 13, 14, 15, 16, 17, 18, 19, or 20 additional bacterial strains belonging to the species *Weissella cibaria*. In some embodiments, the 16S rDNA sequence of an additional bacterial strain belonging to *Weissella cibaria* is not identical to SEQ ID NO: 14. In some embodiments, an additional bacterial strain belonging to *Weissella cibaria* comprises a 16S rDNA sequence that has at least 97%, but less than 100%, sequence identity to the nucleic acid sequence of SEQ ID NO: 14. In some embodiments, each additional bacterial strain belonging to the species *Weissella cibaria* comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 31. In some embodiments, each additional bacterial strain belonging to the species *Weissella cibaria* comprises a genome with an AF of at least 65%, 70%, 75%, 80%, 85%, 90%, 91%, 92%, 93%, 94%, 95%, 96%, 97%, 98%, or 99% to the reference genome of SEQ ID NO: 31.

In some embodiments, a bacterial mixture comprises 2, 3, 4, 5, 6, 7, 8, 9, 10, 11, 12, 13, 14, 15, 16, 17, 18, 19, or 20 additional bacterial strains belonging to the species *Streptococcus salivarius*. In some embodiments, the 16S rDNA sequence of an additional bacterial strain belonging to *Streptococcus salivarius* is not identical to SEQ ID NO: 15. In some embodiments, an additional bacterial strain belonging to *Streptococcus salivarius* comprises a 16S rDNA sequence that has at least 97%, but less than 100%, sequence identity to the nucleic acid sequence of SEQ ID NO: 15. In some embodiments, each additional bacterial strain belonging to the species *Streptococcus salivarius* comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 32. In some embodiments, each additional bacterial strain belonging to the species *Streptococcus salivarius* comprises a genome with an AF of at least 65%, 70%, 75%, 80%, 85%, 90%, 91%, 92%, 93%, 94%, 95%, 96%, 97%, 98%, or 99% to the reference genome of SEQ ID NO: 32.

In some embodiments, a bacterial mixture comprises 2, 3, 4, 5, 6, 7, 8, 9, 10, 11, 12, 13, 14, 15, 16, 17, 18, 19, or 20 additional bacterial strains belonging to the species *Lactococcus lactis*. In some embodiments, the 16S rDNA sequence of an additional bacterial strain belonging to *Lactococcus lactis* is not identical to SEQ ID NO: 16. In some embodiments, an additional bacterial strain belonging to *Lactococcus lactis* comprises a 16S rDNA sequence that has at least 97%, but less than 100%, sequence identity to the nucleic acid sequence of SEQ ID NO: 16. In some embodiments, each additional bacterial strain belonging to the species *Lactococcus lactis* comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 33. In some embodiments, each additional bacterial strain belonging to the species *Lactococcus lactis* comprises a genome with an AF of at least 65%, 70%, 75%, 80%, 85%, 90%, 91%, 92%, 93%, 94%, 95%, 96%, 97%, 98%, or 99% to the reference genome of SEQ ID NO: 33.

Some embodiments of a composition, nutritional supplement, dental supplement, and/or food product comprise bacterial mixtures containing two or more bacterial strains. In some embodiments, the compositions comprise at least 2, at least 3 at least 4, at least 5, at least 6, at least 7, at least 8, at least 9, at least 10, at least 11, at least 12, at least 13, at least 14, at least 15, at least 16, at least 17, at least 18, at least 19, or up to 20 total bacterial strains. In some embodiments, the composition, nutritional supplement, dental supplement, and/or food product comprises 2-20, 2-19, 2-18, 2-17, 2-16, 2-15, 2-14, 2-13, 2-12, 2-11, 2-10, 2-9, 2-8, 2-7, 2-6, 2-5, 2-4, 2-3, 3-20, 3-19, 3-18, 3-17, 3-16, 3-15, 3-14, 3-13, 3-12, 3-11, 3-10, 3-9, 3-8, 3-7, 3-6, 3-5, 3-4, 4-20, 4-19, 4-18, 4-17, 4-16, 4-15, 4-14, 4-13, 4-12, 4-11, 4-10, 4-9, 4-8, 4-7, 4-6, 4-5, 5-20, 5-19, 5-18, 5-17, 5-16, 5-15, 5-14, 5-13, 5-12, 5-11, 5-10, 5-9, 5-8, 5-7, 5-6, 6-20, 6-19, 6-18, 6-17, 6-16, 6-15, 6-14, 6-13, 6-12, 6-11, 6-10, 6-9, 6-8, 6-7, 7-20, 7-19, 7-18, 7-17, 7-16, 7-15, 7-14, 7-13, 7-12, 7-11, 7-10, 7-9, 7-8, 8-20, 8-19, 8-18, 8-17, 8-16, 8-15, 8-14, 8-13, 8-12, 8-11, 8-10, 8-9, 9-20, 9-19, 9-18, 9-17, 9-16, 9-15, 9-14, 9-13, 9-12, 9-11, 9-10, 10-20, 10-19, 10-18, 10-17, 10-16, 10-15, 10-14, 10-13, 10-12, 10-11, 11-20, 11-19, 11-18, 11-17, 11-16, 11-15, 11-14, 11-13, 11-12, 12-20, 12-19, 12-18, 12-17, 12-16, 12-15, 12-14, 12-13, 13-20, 13-19, 13-18, 13-17, 13-16, 13-15, 13-14, 14-20, 14-19, 14-18, 14-17, 14-16, 14-15, 15-20, 15-19, 15-18, 15-17, 15-16, 16-20, 16-19, 16-18, 16-17, 17-20, 17-19, 17-18, 18-20, 18-19, or 19-20 bacterial strains.

In some embodiments, the composition, nutritional supplement, dental supplement, and/or food product comprises a mixture of bacterial strains that consists of 2-20, 2-19, 2-18, 2-17, 2-16, 2-15, 2-14, 2-13, 2-12, 2-11, 2-10, 2-9, 2-8, 2-7, 2-6, 2-5, 2-4, 2-3, 3-20, 3-19, 3-18, 3-17, 3-16, 3-15, 3-14, 3-13, 3-12, 3-11, 3-10, 3-9, 3-8, 3-7, 3-6, 3-5, 3-4, 4-20, 4-19, 4-18, 4-17, 4-16, 4-15, 4-14, 4-13, 4-12, 4-11, 4-10, 4-9, 4-8, 4-7, 4-6, 4-5, 5-20, 5-19, 5-18, 5-17, 5-16, 5-15, 5-14, 5-13, 5-12, 5-11, 5-10, 5-9, 5-8, 5-7, 5-6, 6-20, 6-19, 6-18, 6-17, 6-16, 6-15, 6-14, 6-13, 6-12, 6-11, 6-10, 6-9, 6-8, 6-7, 7-20, 7-19, 7-18, 7-17, 7-16, 7-15, 7-14, 7-13, 7-12, 7-11, 7-10, 7-9, 7-8, 8-20, 8-19, 8-18, 8-17, 8-16, 8-15, 8-14, 8-13, 8-12, 8-11, 8-10, 8-9, 9-20, 9-19, 9-18, 9-17, 9-16, 9-15, 9-14, 9-13, 9-12, 9-11, 9-10, 10-20, 10-19, 10-18, 10-17, 10-16, 10-15, 10-14, 10-13, 10-12, 10-11, 11-20, 11-19, 11-18, 11-17, 11-16, 11-15, 11-14, 11-13, 11-12, 12-20, 12-19, 12-18, 12-17, 12-16, 12-15, 12-14, 12-13, 13-20, 13-19, 13-18, 13-17, 13-16, 13-15, 13-14, 14-20, 14-19, 14-18, 14-17, 14-16, 14-15, 15-20, 15-19, 15-18, 15-17, 15-16, 16-20, 16-19, 16-18, 16-17, 17-20, 17-19, 17-18, 18-20, 18-19, or 19-20 strains.

It will be appreciated that the terms "bacterial strains," "microbial strains" "microbes," "bacterial cells" and "microorganisms" are used interchangeably herein.

Bacterial strains identified as described herein were compared with sequences in publicly available nucleic acid databases, such as Basic Local Alignment Search Tool (BLAST) to determine closely related genera and species and were analyzed using taxonomic assignment tools, such as RDP Classifier, which assign bacterial taxonomy to representative sequences.

Ribosomal 16S DNA sequences are provided below for representative bacterial strains. The closest related identified bacterial species were determined based on whole genome sequence analysis and a combination of analysis of full length 16S rDNA sequences and the sequences of single-copy conserved genes compared to publicly available sequence databases. It should be appreciated that multiple bacterial strains disclosed herein may have the highest homology with the same species. In some embodiments, bacterial strains having the same or highly related 16S rDNA variable region sequences are phenotypically distinct. For example, two strains may differ phenotypically by growth rate, antibiotic resistance, phage resistance, cell wall thickness, motility, competence, spore-forming ability, rates of metabolite (e.g., VSC) degradation, ability to degrade a given metabolite, and/or ability to inhibit production of a given molecule. It should further be appreciated that the bacterial strains disclosed herein that have a 16S rDNA sequence with a nucleic acid sequence selected from the group consisting of SEQ ID NOs:1-17, are also homologous to other strains based on their whole genome sequence, or subset of their whole genome sequence.

It should further be appreciated that the bacterial species described herein may be identified based on the nucleotide sequence of the full length 16S rDNA. Alternatively or in addition, the bacterial species described herein may be identified based on identification of 16S sequences through whole genome sequencing, and by comparing the sequences with 16S databases, or comparing the whole genome sequence, or a subset of their whole genome sequence to sequence databases.

It should be appreciated that the compositions, nutritional supplements, dental supplements, and/or food products may include multiple strains of a particular species. In some embodiments, the composition includes multiple strains of a particular species that are obtained from independent sources but the strains have the same or highly related 16S rDNA sequences.

Aspects of the present disclosure relate to bacterial strains with 16S rDNA sequences that have sequence identity to a nucleic acid sequence of any one of the sequences of the bacterial strains or bacterial species described herein.

In some embodiments, a 16S rDNA sequence has at least 60%, at least 70%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or up to 100% sequence identity to the nucleotide sequence of the specified SEQ ID NO. It would be appreciated by one of skill in the art that the term "sequence identity" or "percent sequence identity," in the context of two or more nucleic acid sequences or amino acid sequences, refers to a measure of similarity between two or more sequences or portion(s) thereof.

"Identity" refers to the degree of sequence relatedness between or among sequences as determined by the number of matching positions between strings of two or more nucleotide sequences. "Percent (%) identity" or "percent (%) sequence identity" as it applies to nucleotide sequences is defined as the percentage of nucleotides in the candidate nucleotide sequence that are identical to the nucleotide sequence of a reference sequence after aligning the sequences and introducing gaps, as necessary, to achieve the maximum score allowed by the alignment algorithm and parameters.

Where an alignment between two sequences is contemplated, the first sequence (e.g., candidate sequence) is aligned to the second sequence (e.g., reference sequence) using the Needleman-Wunsch algorithm for global alignment of the two sequences. Needleman & Wunsch, *J Mol Biol.* 1970. 48:443-453. Where two nucleotide sequences are aligned, the alignment uses an EDNAFULL substitution scoring matrix, a Gap Open penalty of 10, a Gap Extend penalty of 0.5, and no End Gap penalties. The skilled artisan will appreciate that at the time of filing the instant specification, these parameters are the default parameters of the EMBOSS Needle pairwise comparison tool provided by European Bioinformatics Institute (see ebi.ac.uk). Other suitable alignment programs may be used to obtain a global alignment using these parameters, such as BLAST, or the Needleman-Wunsch algorithm may be implemented in a scripting language (e.g., Python).

The percent sequence identity that a candidate sequence (e.g., as present in a bacterial strain encompassed by a claim) has to a reference sequence (e.g., having a SEQ ID NO: specified herein and recited in a claim) is calculated by (i) aligning the candidate sequence to the reference sequence, (ii) determining the number of matching nucleotides between the aligned candidate and reference sequences, and (iii) dividing the number of matching nucleotides by the length of the reference sequence, including any internal gaps introduced into the reference sequence when the two sequences are aligned.

The skilled artisan will appreciate that to determine whether a candidate nucleotide sequence comprises a nucleotide sequence with a given percentage sequence identity to a reference sequence, the denominator (length of reference sequence plus internal gaps) in calculating percent identity need not include gaps shown extending past the ends of the reference sequence in an alignment. Such gaps are added where a candidate sequence contains additional nucleotides that extend beyond the portions of the candidate sequence that align to the 5' end or 3' end of the reference sequence.

Some embodiments relate to bacterial strains comprising a genome (i.e., a chromosome having a nucleotide sequence) with a specified average nucleotide identity (ANI) and/or alignment fraction (AF) to a reference genome. ANI refers to average nucleotide identity of a genome (e.g., as present in a bacterial strain recited in a claim) to a reference genome (e.g., as provided in an Accession No. or SEQ ID NO.), when comparing orthologous genes between the two genomes. The skilled artisan will understand that ANI is not a calculation percent identity obtained by alignment of two full-length genome sequences. Rather, two genomes are compared to identify genes that are conserved between both genomes, and the average nucleotide identity of all conserved genes is calculated. Konstantinidis & Tiedje, *Proc Natl Acad Sci USA.* 2005. 102(7):2567-2572. Where ANI and/or AF are contemplated, these parameters are calculated using skani v. 0.2.1 and default configuration. Shaw & Yu, *Nat Methods.* 2023. 20:1661-1665. A genome will be understood to require the following to be suitable for calculation of ANI to a reference genome: (i) an AF of 65% or more to the reference genome; (ii) at least 150,000 nucleotides among aligned sequence(s) to the reference genome; (iii) CheckM completeness estimate of 50% or more; and (iv) CheckM contamination estimate of less than 10%. See Parks et al., *Nat Biotechnol.* 2018. 36:996-1004.

As will be appreciated by one of ordinary skill in the art, nomenclature regarding bacterial genus and species names may be reclassified to reflect phylogenetic relationships of microorganisms. See, e.g., Zheng et al. *Inter. J. System. And Evol. Microbiol.* (2020) 70(4).

Components of Compositions

Any of the compositions may comprise one or more additional components in addition to bacterial strain(s). In some embodiments, the composition further comprises an antioxidant. Non-limiting examples of antioxidants include vitamins, organic acids, polyphenols, indole-containing compounds, and phenols.

In some embodiments, the composition comprises one or more organic acids. Non-limiting examples of organic acids include lactic acid, ascorbic acid, acetic acid, acrylic acid, propionic acid, pyruvic acid, and citric acid. In some embodiments, a composition comprises lactic acid. In some embodiments, a composition comprises ascorbic acid. In some embodiments, the composition comprises acetic acid. In some embodiments, the composition comprises acrylic acid. In some embodiments, the composition comprises propionic acid. In some embodiments, the composition comprises pyruvic acid. In some embodiments, the composition comprises citric acid. In some embodiments, the composition comprises a combination of two or more of the aforementioned organic acids. In some embodiments, the composition comprises 2, 3, 4, 5, 6, or 7 organic acids selected from lactic acid, ascorbic acid, acetic acid, acrylic acid, propionic acid, pyruvic acid, and citric acid.

In some embodiments, the composition comprises one or more indole-containing compounds. Non-limiting examples of indole-containing compounds include indoleacrylic acid, indolepropionic acid, indoleacetic acid, indole-3-carbinol, indole-3-acetamine, indolealdehyde, indolelactic acid, indolepyruvate, tryptophol, and indole. In some embodiments, the composition comprises indoleacrylic acid. In some embodiments, the composition comprises indolepropionic acid. In some embodiments, the composition comprises indoleacetic acid. In some embodiments, the composition comprises indole-3-carbinol. In some embodiments, the composition comprises indole-3-acetamine. In some embodiments, the composition comprises indolealdehyde. In some embodiments, the composition comprises indolelactic acid. In some embodiments, the composition comprises indolepyruvate. In some embodiments, the composition comprises tryptophol. In some embodiments, the composition comprises indole. In some embodiments, the composition comprises a combination of two or more of the aforementioned indole-containing compounds. In some embodiments, the composition comprises 2, 3, 4, 5, 6, 7, 8, 9, or 10 of indoleacrylic acid, indolepropionic acid, indoleacetic acid, indole-3-carbinol, indole-3-acetamine, indolealdehyde, indolelactic acid, indolepyruvate, tryptophol, and indole.

In some embodiments, the composition comprises one or more vitamins. Non-limiting examples of vitamins include vitamin A, vitamin $B_1$, vitamin $B_2$, vitamin $B_6$, vitamin $B_{12}$, vitamin C, vitamin $D_3$, vitamin E, and vitamin K. In some embodiments, the composition comprises vitamin A. In some embodiments, the composition comprises vitamin $B_1$. In some embodiments, the composition comprises vitamin $B_2$. In some embodiments, a composition comprises vitamin $B_6$. In some embodiments, the composition comprises vitamin $B_{12}$. In some embodiments, the composition comprises vitamin C. In some embodiments, the composition comprises vitamin $D_3$. In some embodiments, the composition comprises vitamin E. In some embodiments, the composition comprises vitamin K. In some embodiments, the composition comprises the combination of two more of the aforementioned vitamins. In some embodiments, the composition comprises 2, 3, 4, 5, 6, 7, 8, or 9 of vitamin A, vitamin $B_1$, vitamin $B_2$, vitamin $B_6$, vitamin $B_{12}$, vitamin C, vitamin $D_3$, vitamin E, and vitamin K.

In some embodiments, the composition comprises one or more polyphenols. Non-limiting examples of polyphenols include green tea polyphenols, tannins, resveratrol, flavonoids, and anthrocyanins. In some embodiments, the composition comprises one or more green tea polyphenols. In some embodiments, the composition comprises one or more tannins. In some embodiments, the composition comprises resveratrol. In some embodiments, the composition comprises one or more flavonoids. In some embodiments, the composition comprises one or more anthrocyanins. In some embodiments, the composition comprises a combination of two more of the aforementioned polyphenols. In some embodiments, the composition comprises 2, 3, 4, or 5 of (i) a green tea polyphenol, (ii) a tannin; (iii) resveratrol; (iv) a flavonoid; and (v) an anthrocyanin.

In some embodiments, the composition comprises 0.1 to 10, 0.2 to 10, 0.3 to 10, 0.4 to 10, 0.5 to 10, 0.6 to 10, 0.7 to 10, 0.8 to 10, 0.9 to 10, 1 to 10, 1.5 to 10, 2 to 10, 3 to 10, 4 to 10, 5 to 10, 6 to 10, 7 to 10, 8 to 10, or 9 to 10 percent (w/w) of an antioxidant. In some embodiments, the composition comprises 0.1% to 10% (w/w) of an antioxidant. In some embodiments, the composition comprises 0.1%, 0.2%, 0.3%, 0.4%, 0.5%, 0.6%, 0.7%, 0.8%, 0.9%, 1.0%, 1.5%, 2.0%, 2.5%, 3.0%, 3.5%, 4.0%, 4.5%, 5.0%, 5.5%, 6.0%, 6.5%, 7.0%, 7.5%, 8.0%, 8.5%, 9.0%, 9.5%, or 10% (w/w) of an antioxidant. In some embodiments, the composition comprises 0.1 to 0.5, 0.5 to 1.0, 1.0 to 1.5, 1.5 to 2.0, 2.0 to 3.0, 3.0 to 4.0, 4.0 to 5.0, 5.0 to 6.0, 6.0 to 7.0, 7.0 to 8.0, 8.0 to 9.0, or 9.0 to 10 percent (w/w) of an antioxidant.

In some embodiments, the composition comprises at least 1 µM, at least 2 µM, at least 3 µM, at least 4 µM, at least 5 µM, at least 6 µM, at least 7 µM, at least 8 µM, at least 9 µM, at least 10 µM, at least 20 µM, at least 30 µM, at least 40 µM, at least 50 µM, at least 60 PM, at least 70 µM, at least 80 µM, at least 90 µM, at least 100 µM, at least 150 µM, at least 200 PM, at least 250 µM, at least 300 µM, or at least 350 µM green tea polyphenol. In some embodiments, a green tea polyphenol is present in a composition at a concentration of 1 to 400, 2 to 400, 3 to 400, 4 to 400, 5 to 400, 10 to 400, 20 to 400, 30 to 400, 40 to 400, 50 to 400, 60 to 400, 70 to 400, 80 to 400, 90 to 400, 100 to 400, 150 to 400, 200 to 400, 250 to 400, 300 to 400, or 350 to 400 µM. In some embodiments, a green tea polyphenol is present in a composition at a concentration of 4 to 400, 4 to 350, 4 to 300, 4 to 250, 4 to 200, 4 to 150, 4 to 100 µM.

Nutritional Supplements, Dental Supplements, and Food Products

Some aspects of the disclosure relate to nutritional supplements comprising any of the compositions or bacterial mixtures described herein. Some aspects of the disclosure relate to dental supplements comprising any of the compositions or bacterial mixtures described herein. Some aspects of the disclosure relate to food products comprising any of the compositions or bacterial mixtures described herein. Food products and nutritional supplements are, in general, intended for the consumption of a human or an animal, such as a companion animal (e.g., a dog), or a bird. As will be appreciated by one of ordinary skill in the art, a food product provides a primary caloric and nutritive source intended for consumption by a subject (e.g., a feed or treat). In contrast, a nutritional supplement is not intended to provide a primary caloric or nutritive source for a subject but rather provides a targeted effect. Nutritional supplements may provide additional nutrients or functional ingredients that complement a standard diet, e.g., a standard pet diet. Dental supplements may be consumed, or be chewed without consuming (e.g., chewed and then spit out), by a human or other animal. Dental supplements are useful, for example, to exercise an animal's teeth and jaws, and to remove bacterial biofilm, plaque, tartar, and/or dental calculus. Any of the bacterial strains, bacterial mixtures thereof, or combinations thereof described herein may be present in a nutritional supplement, dental supplement, or food product. The compositions disclosed herein can be used in a food or beverage, such as a health food, a pet food, a functional food, a dietary supplement, a food or beverage for patients, or an animal feed.

Any of the compositions or bacterial mixtures described herein may be present in a food product, nutritional supplement, or dental supplement. In some embodiments, the bacterial strains are present in spore form in a nutritional supplement, dental supplement, or food product. In some embodiments, the bacterial strains are present in vegetative form in a nutritional supplement, dental supplement, or food product. In some embodiments, the nutritional supplement, dental supplement, or food product comprises both vegetative bacteria and bacteria in spore form. The compositions disclosed herein can be used in a food or beverage, such as a health food, a pet food, a functional food, a dietary supplement, a food or beverage for patients, or an animal feed.

Non-limiting examples of the forms of nutritional supplements, dental supplements, and food products include carbohydrate-containing foods such as rice food products; paste products such as fish hams, sausages, paste products of seafood; pouch products. Further, the examples also include food products and supplements prepared in the forms of powders, granules, kibbles, tablets, capsules, liquids, pastes, chews, and jellies.

Any suitable form may be used for a food product, nutritional supplement, or dental supplement. Non-limiting examples of form factors include dental sticks, dental chews, chews with softer interiors than exteriors, kibbles, and spreads. Additional examples of form factors include a gelatinized starch matrix, extruded or injection-molded dental stick, extruded or injection-molded dental chew, chew having a soft interior, powder meal topper, water additive, dry kibble or food, wet food, frozen food, liquid spray, peanut butter spread, and soft jerky chew.

In some embodiments, the nutritional or dental supplement is an extruded dental stick. In some embodiments, the nutritional or dental supplement is an injection-molded dental stick. In some embodiments, the nutritional or dental supplement is a chew having a soft interior. In some embodiments, the food product, nutritional supplement or dental supplement is a kibble. In some embodiments, the kibble is an extruded kibble. Extruded and/or injection-molded chews, sticks, and kibbles are known in the art, and any suitable method may be used to manufacture such chews, sticks, and kibbles.

In some embodiments, the food product, nutritional supplement or dental supplement is in the form of a wet food. In some embodiments, the food product, nutritional supplement or dental supplement is in the form of a frozen food. Wet foods and frozen foods may be in any suitable form, such as those described in Niamnuy, C., & Devahastin, S. (2010). 11 Pet Foods and Their Physicochemical Properties as Affected by Processing. Contemporary Food Engineering, 327.

In some embodiments, the food product, nutritional supplement, or dental supplement is a soft jerky chew. Jerky chews may be made from any suitable starting material, such as dried meat. In some embodiments, the food product, nutritional supplement, or dental supplement is a spread. In some embodiments, the spread comprises one or more nuts. In some embodiments, the spread is a peanut butter spread. The skilled artisan will appreciate that a food product or supplement intended for consumption by a particular animal will not contain ingredients that are toxic to that animal (e.g., macadamia nuts for dogs).

In some embodiments, the nutritional supplement is an additive. Additives may be added to other foods or food products before consumption by an animal. In some embodiments, the nutritional supplement is a water additive. Water additives are added to drinking water. In some embodiments, the nutritional supplement is a meal topper. Meal toppers may be added directly to food before consumption, with or without incorporation before consumption. In some embodiments, the meal topper is in powder form (a powder meal topper). In some embodiments, the nutritional supplement is a liquid spray. Liquid sprays may be administered directly to an animal, or sprayed on food or in water, with or without incorporation before consumption.

In some embodiments, the nutritional supplement, dental supplement, or food product comprises any of the bacterial mixtures as described herein, and a carrier. The carrier may contain any combination of nutrients, excipients, diluents, and/or binders. In some embodiments, the carrier comprises one or more of the following compounds: water, glycerol, ethylene glycol, 1,2-propylene glycol or 1,3-propylene glycol, sodium chloride, sodium benzoate, potassium sorbate, sodium sulfate, potassium sulfate, magnesium sulfate, sodium thiosulfate, calcium carbonate, sodium citrate, dextrin, maltodextrin, glucose, sucrose, sorbitol, lactose, whey, whey permeate, wheat flour, wheat bran, corn gluten meal, starch and cellulose. In some embodiments, the carrier is a gelatinized starch matrix. In some embodiments, the carrier is maltodextrin.

Nutritional supplements, dental supplements, and/or food products containing the bacterial strains described herein may be produced using methods known in the art and may contain the same amount or number of bacteria (e.g., by weight, amount, or CFU) as the compositions described herein. Selection of an appropriate amount or number of bacteria in the food product may depend on various factors, including for example, the serving size of the food product, the frequency of consumption of the food product, the specific bacterial strains contained, the amount of water present, and/or additional conditions for survival of the bacteria. In some embodiments, a nutritional supplement, dental supplement, and/or food product comprises $10^6$ to $10^{12}$ colony forming units (CFUs) of each bacterial strain of a microbial mixture, per gram. In some embodiments, the nutritional supplement, dental supplement, and/or food product comprises $10^8$ to $10^{10}$ CFUs of each bacterial strain of the microbial mixture per gram. In some embodiments, the nutritional supplement, dental supplement, and/or food product comprises $10^5$ to $10^{13}$ CFUs of each bacterial strain of the microbial mixture per gram. In some embodiments, the nutritional supplement, dental supplement, and/or food product comprises $10^5$ to $10^{10}$ CFUs of each bacterial strain of the microbial mixture per gram. In some embodiments, the nutritional supplement, dental supplement, and/or food product comprises $10^6$ to $10^{10}$ CFUs of each bacterial strain of the microbial mixture per gram.

In some embodiments, the nutritional supplement, dental supplement, and/or food product comprises $10^6$ to $10^{12}$ CFUs of each bacterial strain of the microbial mixture per dosage form. In some embodiments, the nutritional supplement, dental supplement, and/or food product comprises $10^8$ to $10^{10}$ CFUs of each bacterial strain of the microbial mixture per dosage form. In some embodiments, the nutritional supplement, dental supplement, and/or food product comprises $10^5$ to $10^{13}$ CFUs of each bacterial strain of the microbial mixture per dosage form. In some embodiments, the nutritional supplement, dental supplement, and/or food product comprises $10^5$ to $10^{10}$ CFUs of each bacterial strain of the microbial mixture per dosage form. In some embodiments, the nutritional supplement, dental supplement, and/or food product comprises $10^6$ to $10^{10}$ CFUs of each bacterial strain of the microbial mixture per dosage form. A dosage form refers to the smallest physical unit that is not intended to be divided when administered to a subject (e.g., a single capsule, a single treat, a single dental chew stick, or a single sachet of powder).

In some embodiments, the nutritional supplement, dental supplement, and/or food product comprises $10^6$ to $10^{12}$ CFUs of each bacterial strain of the microbial mixture per recommended serving size. In some embodiments, the nutritional supplement, dental supplement, and/or food product comprises $10^8$ to $10^{10}$ CFUs of each bacterial strain of the microbial mixture per recommended serving size. In some embodiments, the nutritional supplement, dental supplement, and/or food product comprises $10^5$ to $10^{13}$ CFUs of each bacterial strain of the microbial mixture per recommended serving size. In some embodiments, the nutritional supplement, dental supplement, and/or food product comprises $10^5$ to $10^{10}$ CFUs of each bacterial strain of the microbial mixture per recommended serving size. In some embodiments, the nutritional supplement, dental supplement, and/or food product comprises $10^6$ to $10^{10}$ CFUs of each bacterial strain of the microbial mixture per recommended serving size. A recommended serving size refers to an amount that is recommended for administration by a product label (e.g., 30 g of powder, 2 chews, or 8 oz of kibble).

In some embodiments, the nutritional supplement, dental supplement, and/or food product comprises $10^6$ to $10^{12}$ CFUs of each bacterial strain of the microbial mixture per recommended dose per day. In some embodiments, the nutritional supplement, dental supplement, and/or food product comprises $10^8$ to $10^{10}$ CFUs of each bacterial strain of the microbial mixture per recommended dose per day. In some embodiments, the nutritional supplement, dental supplement, and/or food product comprises $10^5$ to $10^{13}$ CFUs of each bacterial strain of the microbial mixture per recommended dose per day. In some embodiments, the nutritional supplement, dental supplement, and/or food product comprises $10^5$ to $10^{10}$ CFUs of each bacterial strain of the microbial mixture per recommended dose per day. In some embodiments, the nutritional supplement, dental supplement, and/or food product comprises $10^6$ to $10^{10}$ CFUs of each bacterial strain of the microbial mixture per recommended dose per day. A recommended dose per day refers to a cumulative amount that is recommended for administration over the course of 24 hours (e.g., 24 oz of kibble, 6 chews, 90 g of powder).

Nutritional supplements, dental supplements, and/or food products may comprise one or more nutrients in addition to the bacterial strains. For example, a nutritional supplement, dental supplement, and/or food product may comprise a carbohydrate or carbohydrate source. Non-limiting examples of carbohydrate sources include grains, such as corn, rice, milo, sorghum, barley, alfalfa, oats, and wheat. In some embodiments, the nutritional supplement, dental supplement, and/or food product comprises a grain. In some embodiments, the nutritional supplement, dental supplement, and/or food product comprises wheat, corn, rice, oats, and/or barley. The nutritional supplement, dental supplement, and/or food product may also comprise a gelatinized starch matrix. Matrices of gelatinized starch may comprise any starch listed herein, or another starch known in the art.

Nutritional supplements, dental supplements, and/or food products may comprise a fiber. Fibers may add bulk to a composition, such as a nutritional supplement, and be fermented by intestinal bacteria to produce short-chain fatty acids and other metabolites. Non-limiting examples of fibers include beet pulp (e.g., sugar beet pulp), gum arabic, gum talha, *psyllium*, rice bran, carob bean gum, citrus pulp, pectin, fructooligosaccharide, mannaoligofructose, soy fiber, arabinogalactan, galactooligosaccharide, arabinoxylan, chicory pulp, chicory, coconut endosperm fiber, wheat fiber, and inulin.

Nutritional supplements, dental supplements, and/or food products may comprise an algae. Algae may add one or more nutrients and/or bulk to a composition. Non-limiting examples of algae include Ascophylum nodosum, *Spirulina* (e.g., *Arthrospira platensis, Arthrospira fusiformis*, and *Arthrospira* maxima), and/or *Fucus viscosus.*

Nutritional supplements, dental supplements, and/or food products may comprise one or more inorganic minerals. Non-limiting examples of minerals include Calcium carbonate, calcium, boron, selenium, calcium chloride, chloride, ferrous fumarate, zinc acetate, choline chloride, chromium, ferrous gluconate, zinc sulfate, chromium, tripicolinate, cobalt, magnesium oxide, zinc gluconate, dicalcium phosphate, copper, magnesium sulfate, ferrous sulfate, iodine, magnesium carbonate, monosodium phosphate, iron, chromium picolinate, potassium chloride, magnesium, calcium citrate, potassium citrate, manganese, calcium lactate, potassium sorbate, phosphorus, calcium gluconate, sodium bisulfate, potassium, chromium chloride, sodium hexametaphosphate, sodium, chromium nicotinate, tricalcium phosphate, zinc, and chromium citrate.

Nutritional supplements, dental supplements, and/or food products may comprise one or more protein sources. Non-limiting examples of such protein sources include chicken meals, chicken, chicken byproduct meals, eggs, lamb, lamb meals, turkey, turkey meals, beef, beef by-products, viscera, fish, fish meal, enterals, kangaroo, white fish, venison, blood marrow, bone marrow, soybean meal, soy protein isolate, and soy protein concentrate.

Nutritional supplements, dental supplements, and/or food products may comprise one or more starches. Non-limiting examples of such starches include cereals, grains, corn, wheat, rice, oats, corn grits, sorghum, grain sorghum, milo, wheat bran, oat bran, amaranth, durum, and semolina.

Nutritional supplements, dental supplements, and/or food products may comprise one or more dairy products. Dairy products include, without limitation, cream, milk, butter, and cheese.

In some embodiments, any of the nutritional supplements, dental supplements, and/or food products described herein may comprise a meat or animal-derived material (e.g., animal-derived protein source). In some embodiments, the meat or animal-derived material is beef, chicken, eggs, turkey, lamb, fish, blood marrow, bone marrow, or a combination of any thereof.

Some aspects of the disclosure relate to methods of producing nutritional supplements, dental supplements, and/or food products by combining a bacterial mixture or composition as described herein with a carrier. Bacterial strains and other components of a composition, nutritional supplement, dental supplement, or food product, such as a carrier, excipient, or diluent, may be combined in any amount suitable for producing a final mixture having one or more desired characteristics, such as volume, texture, bacterial amount, and/or nutritional content. Bacterial strains may be cultured independently and combined to produce a bacterial mixture, which is then combined with other components of a composition, nutritional supplement, dental supplement, or food product. Alternatively, bacterial strains may be cultured together, and the community may be combined with other components of a composition, nutritional supplement, dental supplement, or food product. Nutritional supplements, dental supplements, and/or food products containing bacterial strains may be prepared by mixing bacterial strains with other ingredients to produce any solid or liquid formulation as described herein, such as rice food products; paste products such as fish hams, sausages, paste products of seafood; pouch products, powders, granules, kibbles, tablets, chews, capsules, liquids, pastes, and jellies.

Bacterial strains may be combined with a humectant in a composition, nutritional supplement, dental supplement, or food product. Humectants preserve or retain moisture in a composition (e.g., a nutritional supplement), thereby preventing the composition from becoming undesirably dry or developing an undesirably brittle texture. In some embodiments, the bacterial strains are dried (e.g., spray-dried or lyophilized) before being combined with one or more other components of a composition, nutritional supplement, dental supplement, or food product. In some embodiments, the bacterial strains are in spore form when they are combined with one or more other components of a composition, nutritional supplement, dental supplement, or food product. In some embodiments, bacterial strains are combined with a gelatinized starch matrix. In some embodiments, the bacterial strains are combined with maltodextrin.

Methods of Use

Some aspects of the disclosure relate to administration of any of the compositions, nutritional supplements, dental supplements, and/or food products described herein to a subject in need thereof. Administration may be accomplished through any means known in the art. In some embodiments, any of the compositions, nutritional supplements, dental supplements, and/or food products described herein are administered orally. Oral administration may refer to manual administration, such as oral gavage or spraying (e.g., via aerosol). Oral administration may also refer to feeding, such as providing the composition, nutritional supplement, dental supplement, or food product to a subject (e.g., a companion animal), which ingests it by eating or drinking. Methods may include a single administration or administration may be repeated. Repeat administrations may be conducted at regular intervals (e.g., daily or weekly). For example, a subject may be administered a composition or supplement one or more times daily, over a specified time period, such as a week, several weeks, a month, or several months. Alternatively, multiple instances of administration may be conducted on an as-needed basis. In some embodiments, bacterial strains of a composition, nutritional supplement, dental supplement, or food product are delivered to the intestine. In some embodiments, bacteria are delivered to the colon. Such delivery to the intestine or colon may be accomplished by oral or rectal administration.

In some embodiments, a composition, nutritional supplement, dental supplement, or food product is administered in an effective amount for treating, preventing, or alleviating one or more symptoms in a subject. An "effective amount" or "effective dosage" refers to an amount or dosage, respectively, sufficient to treat, alleviate, or prevent a sign or symptom in a subject. The actual effective amount or dosage will depend on the individual subject and their health. Such effective amounts or dosages may be determined by routine assays known to those of skill in the art. In some embodiments, a composition, nutritional supplement, dental supplement, or food product is administered in an effective amount to treat or prevent a symptom associated with inflammation. In some embodiments, the composition, nutritional supplement, dental supplement, or food product is administered in an effective amount to reduce inflammation in the subject. In some embodiments, the composition, nutritional supplement, dental supplement, or food product is administered in an effective amount to treat or prevent diarrhea in the subject. In some embodiments, the composition, nutritional supplement, dental supplement, or food product is administered in an effective amount to treat or prevent vomiting in the subject. In some embodiments, the composition, nutritional supplement, dental supplement, or food product is administered in an effective amount to treat or prevent itching, or skin irritation, in the subject. In some embodiments, the composition, nutritional supplement, dental supplement, or food product is administered in an effective amount to treat or prevent one or more allergy symptoms in the subject.

Subjects to which any of the compositions, nutritional supplements, dental supplements, and/or food products described herein may be administered include any animal known in the art. In some embodiments, the subject is a human. In some embodiments, the animal is a domesticated animal. In some embodiments, the animal is a carnivore. In some embodiments, the animal is a rodent. In some embodiments, the rodent is a mouse, rat, guinea pig, chinchilla, or hamster. In some embodiments, the animal is a dog, cat, rabbit, guinea pig, hamster, or ferret. In some embodiments, the animal is a dog. In some embodiments, the animal is a bovine, swine, llama, alpaca, sheep, or goat. In some embodiments, the animal is a bird.

In some embodiments, the compositions, nutritional supplements, dental supplements, and food products may be effective in reducing one or more symptoms, such as bad breath, gingivitis, dental calculus buildup, inflammation, diarrhea, vomiting, itching, constipation, lack of appetite, lethargy, arthritis, excessive grooming, abdominal pain, and fever. In some embodiments, the compositions, nutritional supplements, dental supplements, and food products treat or prevent bad breath in the subject. In some embodiments, the compositions, nutritional supplements, dental supplements, and food products treat or prevent gingivitis in the subject. In some embodiments, the compositions, nutritional supplements, dental supplements, and food products treat or prevent dental calculus buildup in the subject. In some embodiments, the compositions, nutritional supplements, dental supplements, and food products treat or prevent diarrhea in the subject. In some embodiments, the compositions, nutritional supplements, dental supplements, and food products treat or prevent vomiting or nausea in the subject.

In some embodiments, a composition is administered to a subject having halitosis. Signs and symptoms of halitosis include unpleasant breath containing one or more volatile sulfur compounds, gingivitis, and accumulation of plaque, tartar, and/or dental calculus on teeth of the subject. In some embodiments, the oral microenvironment of the subject comprises one or more microorganisms associated with halitosis. Exemplary microorganisms associated with halitosis include, without limitation, *Porphyromonas gingivalis, Prevotella intermedia, Porphyromonas canigingivalis, Tannerella forsythia, Treponema denticola,* and *Fusobacterium nucleatum.* In some embodiments, the subject's oral microenvironment comprises *Porphyromonas gingivalis.* In some embodiments, the subject's oral microenvironment comprises *Prevotella intermedia.* In some embodiments, the subject's oral microenvironment comprises *Porphyromonas canigingivalis.* In some embodiments, the subject's oral microenvironment comprises *Tannerella forsythia.* In some embodiments, the subject's oral microenvironment comprises *Treponema denticola.* In some embodiments, the subject's oral microenvironment comprises *Fusobacterium nucleatum.* In some embodiments, the compositions, nutritional supplements, dental supplements, and food products described herein reduce the abundance of one or more microorganisms associated with halitosis in the subject or the subject's oral microenvironment.

Any suitable method may be used to determine whether a subject's oral microenvironment comprises a given microorganism. For example, culture-based methods, microscopy-based methods, 16S rDNA sequencing, and/or whole-genome sequencing-based methods may be performed on a sample obtained from a subject's oral microenvironment. In some embodiments, one or more microorganisms is present in a saliva sample. In some embodiments, one or more microorganisms is present on oral mucosa of a subject. In some embodiments, one or more microorganisms is present on the tongue of a subject. In some embodiments, one or more microorganisms is present on a tooth of a subject.

In some embodiments, the compositions, nutritional supplements, dental supplements, and food products described herein are effective in treating or preventing one or more symptoms or adverse events in a subject. As discussed above, the bacterial compositions reduce VSC abundance, inhibit VSC production, and/or reduce an alkaline oral environment, thereby improving halitosis. In some embodiments, the compositions, nutritional supplements, dental supplements, and food products reduce VSC abundance in the subject. Methods of measuring VSC abundance are known in the art, and include, without limitation, measuring the concentration of one or more VSCs (e.g., hydrogen sulfide, methyl mercaptan, and dimethyl sulfide) in the subject, such as in a sample obtained from the oral microenvironment (e.g., a breath or saliva sample).

In some embodiments, the compositions, nutritional supplements, dental supplements, and food products reduce inflammation in the subject. In some embodiments, the compositions, nutritional supplements, dental supplements, and food products treat or prevent one or more symptoms associated with inflammation. Methods of measuring inflammation are known in the art, and include, without limitation, measuring the concentration of one or more cytokines (e.g., TNF-$\alpha$, IL-1$\beta$, IL-6, IL-10, and IL-12) in the subject, such as in a sample obtained from the subject (e.g., a blood sample, serum sample, plasma sample). In some embodiments, the compositions, nutritional supplements, dental supplements, and food products reduce infiltration of leukocytes (e.g., neutrophils and/or monocytes) into oral mucosa. In some embodiments, a composition, nutritional supplement, dental supplement, or food product reduces the rate of plaque accumulation, compared to a reference subject (e.g., a subject that has not been administered the composition, nutritional supplement, dental supplement, or food product). In some embodiments, a composition, nutritional supplement, dental supplement, or food product reduces the rate of tartar accumulation, compared to a reference subject (e.g., a subject that has not been administered the composition, nutritional supplement, dental supplement, or food product). In some embodiments, a composition, nutritional supplement, dental supplement, or food product reduces the rate of dental calculus accumulation, compared to a reference subject (e.g., a subject that has not been administered the composition, nutritional supplement, dental supplement, or food product).

In some embodiments administration of a composition results in a decrease in abundance of dental plaque by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, or 100%, as compared to the abundance of dental plaque prior to administering the composition. In some embodiments, administration of a composition results in decrease in the abundance of dental plaque by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, 100%, 125%, 150% or more, as compared to the abundance of dental plaque in a subject (e.g., a reference subject) who did not receive the composition.

In some embodiments administration of a composition results in a decrease in abundance of dental tartar by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, or 100%, as compared to the abundance of dental tartar prior to administering the composition. In some embodiments, administration of a composition results in decrease in the abundance of dental tartar by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, 100%, 125%, 150% or more, as compared to the abundance of dental tartar in a subject (e.g., a reference subject) who did not receive the composition.

In some embodiments administration of a composition results in a decrease in abundance of dental calculus by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, or 100%, as compared to the abundance of dental calculus prior to administering the composition. In some embodiments, administration of a composition results in decrease in the abundance of dental calculus by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, 100%, 125%, 150% or more, as compared to the abundance of dental calculus in a subject (e.g., a reference subject) who did not receive the composition.

In some embodiments, administration of a composition results in a decrease in abundance of one or more microorganisms in the subject (or microbiome thereof) by at least 1.1-fold, 1.2-fold, 1.3-fold, 1.4-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 100-fold, 1000-fold, $10^4$-fold, $10^5$-fold or more, as compared to the abundance of one or more microorganisms in the subject (or microbiome thereof) prior to administering the composition. In some embodiments, administration of the composition results in a decrease in abundance of one or more microorganisms in the subject (or microbiome thereof) by at least 1.1-fold, 1.2-fold, 1.3-fold, 1.4-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 100-fold, 1000-fold, $10^4$-fold, $10^5$-fold or more, as compared to the abundance of one or more microorganisms in another subject (e.g., a reference subject) (or microbiome thereof) who did not receive the composition.

In some embodiments administration of a composition results in a decrease in abundance of one or more microorganisms in the subject (or microbiome thereof) by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, or 100%, as compared to the abundance of the microorganism in the subject (or microbiome thereof) prior to administering the composition. In some embodiments, administration of a composition results in decrease in the abundance of one or more microorganisms in the subject (or microbiome thereof) by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, 100%, 125%, 150% or more, as compared to the abundance of the microorganisms in a subject (e.g., a reference subject) (or microbiome thereof) who did not receive the composition.

In some embodiments, administration of a composition results in a decrease in abundance of *Porphyromonas gingivalis* in the subject (or microbiome thereof) by at least 1.1-fold, 1.2-fold, 1.3-fold, 1.4-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 100-fold, 1000-fold, $10^4$-fold, $10^5$-fold or more, as compared to the abundance of *Porphyromonas gingivalis* in the subject (or microbiome thereof) prior to administering the composition. In some embodiments, administration of the composition results in a decrease in abundance of *Porphyromonas gingivalis* in the subject (or microbiome thereof) by at least 1.1-fold, 1.2-fold, 1.3-fold, 1.4-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 100-fold, 1000-fold, $10^4$-fold, $10^5$-fold or more, as compared to the abundance of *Porphyromonas gingivalis* in another subject (e.g., a reference subject) (or microbiome thereof) who did not receive the composition.

In some embodiments administration of a composition results in a decrease in abundance of *Porphyromonas gingivalis* in the subject (or microbiome thereof) by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, or 100%, as compared to the abundance of *Porphyromonas gingivalis* in the subject (or microbiome thereof) prior to administering the composition. In some embodiments, administration of a composition results in decrease in the abundance of *Porphyromonas gingivalis* in the subject (or microbiome thereof) by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, 100%, 125%, 150% or more, as compared to the abundance of *Porphyromonas gingivalis* in a subject (e.g., a reference subject) (or microbiome thereof) who did not receive the composition.

In some embodiments, administration of a composition results in a decrease in abundance of *Prevotella intermedia* in the subject (or microbiome thereof) by at least 1.1-fold, 1.2-fold, 1.3-fold, 1.4-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 100-fold, 1000-fold, $10^4$-fold, $10^5$-fold or more, as compared to the abundance of *Prevotella intermedia* in the subject (or microbiome thereof) prior to administering the composition. In some embodiments, administration of the composition results in a decrease in abundance of *Prevotella intermedia* in the subject (or microbiome thereof) by at least 1.1-fold, 1.2-fold, 1.3-fold, 1.4-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 100-fold, 1000-fold, $10^4$-fold, $10^5$-fold or more, as compared to the abundance of *Prevotella intermedia* in another subject (e.g., a reference subject) (or microbiome thereof) who did not receive the composition.

In some embodiments administration of a composition results in a decrease in abundance of *Prevotella intermedia* in the subject (or microbiome thereof) by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, or 100%, as compared to the abundance of *Prevotella intermedia* in the subject (or microbiome thereof) prior to administering the composition. In some embodiments, administration of a composition results in decrease in the abundance of *Prevotella intermedia* in the subject (or microbiome thereof) by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, 100%, 125%, 150% or more, as compared to the abundance of *Prevotella intermedia* in a subject (e.g., a reference subject) (or microbiome thereof) who did not receive the composition.

In some embodiments, administration of a composition results in a decrease in abundance of *Porphyromonas canigingivalis* in the subject (or microbiome thereof) by at least 1.1-fold, 1.2-fold, 1.3-fold, 1.4-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 100-fold, 1000-fold, $10^4$-fold, $10^5$-fold or more, as compared to the abundance of *Porphyromonas canigingivalis* in the subject (or microbiome thereof) prior to administering the composition. In some embodiments, administration of the composition results in a decrease in abundance of *Porphyromonas canigingivalis* in the subject (or microbiome thereof) by at least 1.1-fold, 1.2-fold, 1.3-fold, 1.4-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 100-fold, 1000-fold, $10^4$-fold, $10^5$-fold or more, as compared to the abundance of *Porphyromonas canigingivalis* in another subject (e.g., a reference subject) (or microbiome thereof) who did not receive the composition.

In some embodiments administration of a composition results in a decrease in abundance of *Porphyromonas canigingivalis* in the subject (or microbiome thereof) by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, or 100%, as compared to the abundance of *Porphyromonas canigingivalis* in the subject (or microbiome thereof) prior to administering the composition. In some embodiments, administration of a composition results in decrease in the abundance of *Porphyromonas canigingivalis* in the subject (or microbiome thereof) by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, 100%, 125%, 150% or more, as compared to the abundance of *Porphyromonas canigingivalis* in a subject (e.g., a reference subject) (or microbiome thereof) who did not receive the composition.

In some embodiments, administration of a composition results in a decrease in abundance of *Tannerella forsythia* in the subject (or microbiome thereof) by at least 1.1-fold, 1.2-fold, 1.3-fold, 1.4-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 100-fold, 1000-fold, $10^4$-fold, $10^5$-fold or more, as compared to the abundance of *Tannerella forsythia* in the subject (or microbiome thereof) prior to administering the composition. In some embodiments, administration of the composition results in a decrease in abundance of *Tannerella forsythia* in the subject (or microbiome thereof) by at least 1.1-fold, 1.2-fold, 1.3-fold, 1.4-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 100-fold, 1000-fold, $10^4$-fold, $10^5$-fold or more, as compared to the abundance of *Tannerella forsythia* in another subject (e.g., a reference subject) (or microbiome thereof) who did not receive the composition.

In some embodiments administration of a composition results in a decrease in abundance of *Tannerella forsythia* in the subject (or microbiome thereof) by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, or 100%, as compared to the abundance of *Tannerella forsythia* in the subject (or microbiome thereof) prior to administering the composition. In some embodiments, administration of a composition results in decrease in the abundance of *Tannerella forsythia* in the subject (or microbiome thereof) by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, 100%, 125%, 150% or more, as compared to the abundance of *Tannerella forsythia* in a subject (e.g., a reference subject) (or microbiome thereof) who did not receive the composition.

In some embodiments, administration of a composition results in a decrease in abundance of *Treponema denticola* in the subject (or microbiome thereof) by at least 1.1-fold, 1.2-fold, 1.3-fold, 1.4-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 100-fold, 1000-fold, $10^4$-fold, $10^5$-fold or more, as compared to the abundance of *Treponema denticola* in the subject (or microbiome thereof) prior to administering the composition. In some embodiments, administration of the composition results in a decrease in abundance of *Treponema denticola* in the subject (or microbiome thereof) by at least 1.1-fold, 1.2-fold, 1.3-fold, 1.4-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 100-fold, 1000-fold, $10^4$-fold, $10^5$-fold or more, as compared to the abundance of *Treponema denticola* in another subject (e.g., a reference subject) (or microbiome thereof) who did not receive the composition.

In some embodiments administration of a composition results in a decrease in abundance of *Treponema denticola* in the subject (or microbiome thereof) by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, or 100%, as compared to the abundance of *Treponema denticola* in the subject (or microbiome thereof) prior to administering the composition. In some embodiments, administration of a composition results in decrease in the abundance of *Treponema denticola* in the subject (or microbiome thereof) by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, 100%, 125%, 150% or more, as compared to the abundance of *Treponema denticola* in a subject (e.g., a reference subject) (or microbiome thereof) who did not receive the composition.

In some embodiments, administration of a composition results in a decrease in abundance of *Fusobacterium nucleatum* in the subject (or microbiome thereof) by at least 1.1-fold, 1.2-fold, 1.3-fold, 1.4-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 100-fold, 1000-fold, $10^4$-fold, $10^5$-fold or more, as compared to the abundance of *Fusobacterium nucleatum* in the subject (or microbiome thereof) prior to administering the composition. In some embodiments, administration of the composition results in a decrease in abundance of *Fusobacterium nucleatum* in the subject (or microbiome thereof) by at least 1.1-fold, 1.2-fold, 1.3-fold, 1.4-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 100-fold, 1000-fold, $10^4$-fold, $10^5$-fold or more, as compared to the abundance of *Fusobacterium nucleatum* in another subject (e.g., a reference subject) (or microbiome thereof) who did not receive the composition.

In some embodiments administration of a composition results in a decrease in abundance of *Fusobacterium nucleatum* in the subject (or microbiome thereof) by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, or 100%, as compared to the abundance of *Fusobacterium nucleatum* in the subject (or microbiome thereof) prior to administering the composition. In some embodiments, administration of a composition results in decrease in the abundance of *Fusobacterium nucleatum* in the subject (or microbiome thereof) by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, 100%, 125%, 150% or more, as compared to the abundance of *Fusobacterium nucleatum* in a subject (e.g., a reference subject) (or microbiome thereof) who did not receive the composition.

In some embodiments, a composition is administered to a subject having an oral microenvironment with a pH of 7.5 or higher. Halitosis is associated with an alkaline environment (pH of at least 7.5), and so an alkaline microenvironment may indicate that a subject would benefit from administration of a composition useful in alleviating one or more signs or symptoms of halitosis. In some embodiments, a subject has an oral microenvironment with a pH of at least 7.5, at least 7.6, at least 7.7, at least 7.8, at least 7.9, at least 8.0, at least 8.1, at least 8.2, at least 8.3, at least 8.4, or at least 8.5.

In some embodiments, administration of a composition, nutritional supplement, dental supplement, or food product reduces the concentration of 1, 2, 3, 4, 5, 6, 7, 8, 9, 10, 11, 12, 13, 14, 15, 16, 17, 18, 19, or 20 VSCs with distinct structures in the oral microenvironment of the subject. In some embodiments, administration reduces the concentration of 1, 2, or 3 VSCs with distinct structures. In some embodiments, administration reduces the concentration of hydrogen sulfide. In some embodiments, administration reduces the concentration of methyl mercaptan. In some embodiments, administration reduces the concentration of dimethyl sulfide.

In some embodiments, administration reduces the concentration of VSCs in an oral microenvironment by at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90% or at least 95%. In some embodiments, administration reduces the concentration of VSCs by 5-10%, 10-20%, 20-30%, 30-40%, 40-50%, 50-60%, 60-70%, 70-80%, 80-90%, or 90-100%. In some embodiments, administration reduces the concentration of VSCs by 5-95%, 5-90%, 5-80%, 5-70%, 5-60%, 5-50%, 5-40%, 5-30%, 5-25%, 5-20%, 5-15%, or 5-10%. In some embodiments, administration reduces the concentration of VSCs by 5-99%, 10-99%, 15-99%, 20-99%, 25-99%, 30-99%, 40-99%, 50-99%, 60-99%, 70-99%, 80-99%, or 90-99%.

In some embodiments, administration reduces the concentration of VSCs in an alkaline oral microenvironment of the subject. In some embodiments, administration reduces the concentration of VSCs in an oral microenvironment having a pH greater than 7.5. In some embodiments, administration reduces the concentration of VSCs in an oral microenvironment having a pH of at least 7.5. In some embodiments, administration reduces the concentration of VSCs in an oral microenvironment having a pH of 7.5 to 9.0, 7.5 to 8.5, or 7.5 to 8.0. In some embodiments, administration reduces the concentration of VSCs in an oral microenvironment having a pH of at least 8.0, at least 8.5, or at least 9.0.

In some embodiments, administration reduces the concentration of VSCs in an oral microenvironment having a pH of 7.5 or below. In some embodiments, administration reduces the concentration of VSCs in an oral microenvironment having a pH of 5.0 to 7.5, 5.5 to 7.5, 6.0 to 7.5, 6.5 to 7.5, or 7.0 to 7.5. In some embodiments, administration reduces the concentration of VSCs in an oral microenvironment having a pH below 7.5. In some embodiments, administration reduces the concentration of VSCs in an oral microenvironment having a pH of 5.0 to 7.5, 5.5 to 7.5, 6.0 to 7.5, 6.5 to 7.5, or 7.0 to 7.5. In some embodiments, administration reduces the concentration of VSCs in an oral microenvironment having a pH of at most 7.0, at most 6.5, or at most 6.0.

In some embodiments, administration reduces the concentration of hydrogen sulfide in an oral microenvironment by at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90% or at least 95%. In some embodiments, administration reduces the concentration of hydrogen sulfide by 5-10%, 10-20%, 20-30%, 30-40%, 40-50%, 50-60%, 60-70%, 70-80%, 80-90%, or 90-100%. In some embodiments, administration reduces the concentration of hydrogen sulfide by 5-95%, 5-90%, 5-80%, 5-70%, 5-60%, 5-50%, 5-40%, 5-30%, 5-25%, 5-20%, 5-15%, or 5-10%. In some embodiments, administration reduces the concentration of hydrogen sulfide by 5-99%, 10-99%, 15-99%, 20-99%, 25-99%, 30-99%, 40-99%, 50-99%, 60-99%, 70-99%, 80-99%, or 90-99%.

In some embodiments, administration reduces the concentration of hydrogen sulfide in an alkaline oral microenvironment of the subject. In some embodiments, administration reduces the concentration of hydrogen sulfide in an oral microenvironment having a pH greater than 7.5. In some embodiments, administration reduces the concentration of hydrogen sulfide in an oral microenvironment having a pH of at least 7.5. In some embodiments, administration reduces the concentration of hydrogen sulfide in an oral microenvironment having a pH of 7.5 to 9.0, 7.5 to 8.5, or 7.5 to 8.0. In some embodiments, administration reduces the concentration of hydrogen sulfide in an oral microenvironment having a pH of at least 8.0, at least 8.5, or at least 9.0.

In some embodiments, administration reduces the concentration of hydrogen sulfide in an oral microenvironment having a pH of 7.5 or below. In some embodiments, administration reduces the concentration of hydrogen sulfide in an oral microenvironment having a pH of 5.0 to 7.5, 5.5 to 7.5, 6.0 to 7.5, 6.5 to 7.5, or 7.0 to 7.5. In some embodiments, administration reduces the concentration of hydrogen sulfide in an oral microenvironment having a pH below 7.5. In some embodiments, administration reduces the concentration of hydrogen sulfide in an oral microenvironment having a pH of 5.0 to 7.5, 5.5 to 7.5, 6.0 to 7.5, 6.5 to 7.5, or 7.0 to 7.5. In some embodiments, administration reduces the concentration of hydrogen sulfide in an oral microenvironment having a pH of at most 7.0, at most 6.5, or at most 6.0.

In some embodiments, administration reduces the concentration of methyl mercaptan in an oral microenvironment by at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90% or at least 95%. In some embodiments, administration reduces the concentration of methyl mercaptan by 5-10%, 10-20%, 20-30%, 30-40%, 40-50%, 50-60%, 60-70%, 70-80%, 80-90%, or 90-100%. In some embodiments, administration reduces the concentration of methyl mercaptan by 5-95%, 5-90%, 5-80%, 5-70%, 5-60%, 5-50%, 5-40%, 5-30%, 5-25%, 5-20%, 5-15%, or 5-10%. In some embodiments, administration reduces the concentration of methyl mercaptan by 5-99%, 10-99%, 15-99%, 20-99%, 25-99%, 30-99%, 40-99%, 50-99%, 60-99%, 70-99%, 80-99%, or 90-99%.

In some embodiments, administration reduces the concentration of methyl mercaptan in an alkaline oral microenvironment of the subject. In some embodiments, administration reduces the concentration of methyl mercaptan in an oral microenvironment having a pH greater than 7.5. In some embodiments, administration reduces the concentration of methyl mercaptan in an oral microenvironment having a pH of at least 7.5. In some embodiments, administration reduces the concentration of methyl mercaptan in an oral microenvironment having a pH of 7.5 to 9.0, 7.5 to 8.5, or 7.5 to 8.0. In some embodiments, administration reduces the concentration of methyl mercaptan in an oral microenvironment having a pH of at least 8.0, at least 8.5, or at least 9.0.

In some embodiments, administration reduces the concentration of methyl mercaptan in an oral microenvironment having a pH of 7.5 or below. In some embodiments, administration reduces the concentration of methyl mercaptan in an oral microenvironment having a pH of 5.0 to 7.5, 5.5 to 7.5, 6.0 to 7.5, 6.5 to 7.5, or 7.0 to 7.5. In some embodiments, administration reduces the concentration of methyl mercaptan in an oral microenvironment having a pH below 7.5. In some embodiments, administration reduces the concentration of methyl mercaptan in an oral microenvironment having a pH of 5.0 to 7.5, 5.5 to 7.5, 6.0 to 7.5, 6.5 to 7.5, or 7.0 to 7.5. In some embodiments, administration reduces the concentration of methyl mercaptan in an oral microenvironment having a pH of at most 7.0, at most 6.5, or at most 6.0.

In some embodiments, administration reduces the concentration of dimethyl sulfide in an oral microenvironment by at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90% or at least 95%. In some embodiments, administration reduces the concentration of dimethyl sulfide by 5-10%, 10-20%, 20-30%, 30-40%, 40-50%, 50-60%, 60-70%, 70-80%, 80-90%, or 90-100%. In some embodiments, administration reduces the concentration of dimethyl sulfide by 5-95%, 5-90%, 5-80%, 5-70%, 5-60%, 5-50%, 5-40%, 5-30%, 5-25%, 5-20%, 5-15%, or 5-10%. In some embodiments, administration reduces the concentration of dimethyl sulfide by 5-99%, 10-99%, 15-99%, 20-99%, 25-99%, 30-99%, 40-99%, 50-99%, 60-99%, 70-99%, 80-99%, or 90-99%.

In some embodiments, administration reduces the concentration of dimethyl sulfide in an alkaline oral microenvironment of the subject. In some embodiments, administration reduces the concentration of dimethyl sulfide in an oral microenvironment having a pH greater than 7.5. In some embodiments, administration reduces the concentration of dimethyl sulfide in an oral microenvironment having a pH of at least 7.5. In some embodiments, administration reduces the concentration of dimethyl sulfide in an oral microenvironment having a pH of 7.5 to 9.0, 7.5 to 8.5, or 7.5 to 8.0. In some embodiments, administration reduces the concentration of dimethyl sulfide in an oral microenvironment having a pH of at least 8.0, at least 8.5, or at least 9.0.

In some embodiments, administration reduces the concentration of dimethyl sulfide in an oral microenvironment having a pH of 7.5 or below. In some embodiments, administration reduces the concentration of dimethyl sulfide in an oral microenvironment having a pH of 5.0 to 7.5, 5.5 to 7.5, 6.0 to 7.5, 6.5 to 7.5, or 7.0 to 7.5. In some embodiments, administration reduces the concentration of dimethyl sulfide in an oral microenvironment having a pH below 7.5. In some embodiments, administration reduces the concentration of dimethyl sulfide in an oral microenvironment having a pH of 5.0 to 7.5, 5.5 to 7.5, 6.0 to 7.5, 6.5 to 7.5, or 7.0 to 7.5. In some embodiments, administration reduces the concentration of dimethyl sulfide in an oral microenvironment having a pH of at most 7.0, at most 6.5, or at most 6.0.

In some embodiments, administration of a composition, nutritional supplement, dental supplement, or food product results in an increased in the H+ ion concentration of an oral microenvironment by 1.5-fold, 2.0-fold, 2.5-fold, 3.0-fold, 3.16-fold, 3.17-fold, 3.5-fold, 4.0-fold, 5.0-fold, 6.0-fold, 7.0-fold, 8.0-fold, 8.5-fold, 9.0-fold, 10-fold, 15-fold, 20-fold, 25-fold, 30-fold, 31-fold, 32-fold, 40-fold, 50-fold, 60-fold, 70-fold, 80-fold, 90-fold, or 100-fold. In some embodiments, administration reduces the pH of an oral microenvironment by at least 0.5, at least 1.0, at least 1.5, or at least 2.0. In some embodiments, administration reduces the pH of an oral microenvironment to a pH below 7.5.

The extent to which a composition, nutritional supplement, dental supplement, or food product treats or prevents a symptom may be evaluated using methods known in the art, such as monitoring the change in the frequency, occurrence, and/or severity of symptoms following administration of the composition, nutritional supplement, dental supplement, or food product. Additionally, groups of subjects administered the bacterial mixture, composition, or nutritional supplement may be monitored and compared to another group of subjects that was not administered the composition or nutritional supplement, a group that was administered a different amount of the composition, nutritional supplement, dental supplement, or food product, and/or a group that was administered a control composition, nutritional supplement, dental supplement, or food product (e.g., a carrier or excipient lacking the bacterial strains).

Reduction of Volatile Sulfur Compound (VSC) Abundance or Inhibition of VSC Production Some bacterial strains of compositions, nutritional supplements, dental supplements, and food products were identified based on the ability to reduce the abundance of volatile sulfur compounds (VSCs) in an environment, and/or inhibit the production of VSCs by other microorganisms in the environment. VSCs are associated with the unpleasant odor of breath of subjects with halitosis, and reduction in VSC abundance (e.g., by VSC metabolism or inhibition of VSC production) is expected to alleviate this symptom of halitosis. Non-limiting examples of such VSCs include hydrogen sulfide, methyl mercaptan, and dimethyl sulfide, all of which give off strong and unpleasant odors.

In some embodiments, fermentation by bacterial strains of the composition described herein reduces the concentration of 1, 2, 3, 4, 5, 6, 7, 8, 9, 10, 11, 12, 13, 14, 15, 16, 17, 18, 19, or 20 VSCs with distinct structures. In some embodiments, fermentation by bacterial strains of the compositions described herein reduces the concentration of 1, 2, or 3 VSCs with distinct structures. In some embodiments, fermentation by bacterial strains of the compositions described herein reduces the concentration of hydrogen sulfide. In some embodiments, fermentation by bacterial strains of the compositions described herein reduces the concentration of methyl mercaptan. In some embodiments, fermentation by bacterial strains of the compositions described herein reduces the concentration of dimethyl sulfide.

In some embodiments, fermentation reduces the concentration of VSCs by at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90% or at least 95%. In some embodiments, fermentation reduces the concentration of VSCs by 5-10%, 10-20%, 20-30%, 30-40%, 40-50%, 50-60%, 60-70%, 70-80%, 80-90%, or 90-100%. In some embodiments, fermentation reduces the concentration of VSCs by 5-95%, 5-90%, 5-80%, 5-70%, 5-60%, 5-50%, 5-40%, 5-30%, 5-25%, 5-20%, 5-15%, or 5-10%. In some embodiments, fermentation reduces the concentration of VSCs by 5-99%, 10-99%, 15-99%, 20-99%, 25-99%, 30-99%, 40-99%, 50-99%, 60-99%, 70-99%, 80-99%, or 90-99%.

In some embodiments, fermentation in an alkaline environment reduces the concentration of VSCs. In some embodiments, fermentation in an environment having a pH greater than 7.5 reduces the concentration of VSCs. In some embodiments, fermentation in an environment having a pH of at least 7.5 reduces the concentration of VSCs. In some embodiments, fermentation in an environment having a pH of 7.5 to 9.0, 7.5 to 8.5, or 7.5 to 8.0 reduces the concentration of VSCs. In some embodiments, fermentation in an environment having a pH of at least 8.0, at least 8.5, or at least 9.0 reduces the concentration of VSCs. In some embodiments, fermentation in a neutral environment reduces the concentration of VSCs. In some embodiments, fermentation in an environment having a pH of 7.5 or below reduces the concentration of VSCs. In some embodiments, fermentation in an environment having a pH below 7.5 reduces the concentration of VSCs. In some embodiments, fermentation in an environment having a pH of 5.0 to 7.5, 5.5 to 7.5, 6.0 to 7.5, 6.5 to 7.5, or 7.0 to 7.5 reduces the concentration of VSCs. In some embodiments, fermentation in an environment having a pH of at most 7.0, at most 6.5, or at most 6.0 reduces the concentration of VSCs.

In some embodiments, fermentation reduces the concentration of hydrogen sulfide by at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90% or at least 95%. In some embodiments, fermentation reduces the concentration of hydrogen sulfide by 5-10%, 10-20%, 20-30%, 30-40%, 40-50%, 50-60%, 60-70%, 70-80%, 80-90%, or 90-100%. In some embodiments, fermentation reduces the concentration of hydrogen sulfide by 5-95%, 5-90%, 5-80%, 5-70%, 5-60%, 5-50%, 5-40%, 5-30%, 5-25%, 5-20%, 5-15%, or 5-10%. In some embodiments, fermentation reduces the concentration of hydrogen sulfide by 5-99%, 10-99%, 15-99%, 20-99%, 25-99%, 30-99%, 40-99%, 50-99%, 60-99%, 70-99%, 80-99%, or 90-99%.

In some embodiments, fermentation in an alkaline environment reduces the concentration of hydrogen sulfide. In some embodiments, fermentation in an environment having a pH greater than 7.5 reduces the concentration of hydrogen sulfide. In some embodiments, fermentation in an environment having a pH of at least 7.5 reduces the concentration of hydrogen sulfide. In some embodiments, fermentation in an environment having a pH of 7.5 to 9.0, 7.5 to 8.5, or 7.5 to 8.0 reduces the concentration of hydrogen sulfide. In some embodiments, fermentation in an environment having a pH of at least 8.0, at least 8.5, or at least 9.0 reduces the concentration of hydrogen sulfide. In some embodiments, fermentation in a neutral environment reduces the concentration of hydrogen sulfide. In some embodiments, fermentation in an environment having a pH of 7.5 or below reduces the concentration of hydrogen sulfide. In some embodiments, fermentation in an environment having a pH below 7.5 reduces the concentration of hydrogen sulfide. In some embodiments, fermentation in an environment having a pH of 5.0 to 7.5, 5.5 to 7.5, 6.0 to 7.5, 6.5 to 7.5, or 7.0 to 7.5 reduces the concentration of hydrogen sulfide. In some embodiments, fermentation in an environment having a pH of at most 7.0, at most 6.5, or at most 6.0 reduces the concentration of hydrogen sulfide.

In some embodiments, fermentation reduces the concentration of methyl mercaptan by at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90% or at least 95%. In some embodiments, fermentation reduces the concentration of methyl mercaptan by 5-10%, 10-20%, 20-30%, 30-40%, 40-50%, 50-60%, 60-70%, 70-80%, 80-90%, or 90-100%. In some embodiments, fermentation reduces the concentration of methyl mercaptan by 5-95%, 5-90%, 5-80%, 5-70%, 5-60%, 5-50%, 5-40%, 5-30%, 5-25%, 5-20%, 5-15%, or 5-10%. In some embodiments, fermentation reduces the concentration of methyl mercaptan by 5-99%, 10-99%, 15-99%, 20-99%, 25-99%, 30-99%, 40-99%, 50-99%, 60-99%, 70-99%, 80-99%, or 90-99%.

In some embodiments, fermentation in an alkaline environment reduces the concentration of methyl mercaptan. In some embodiments, fermentation in an environment having a pH greater than 7.5 reduces the concentration of methyl mercaptan. In some embodiments, fermentation in an environment having a pH of at least 7.5 reduces the concentration of methyl mercaptan. In some embodiments, fermentation in an environment having a pH of 7.5 to 9.0, 7.5 to 8.5, or 7.5 to 8.0 reduces the concentration of methyl mercaptan. In some embodiments, fermentation in an environment having a pH of at least 8.0, at least 8.5, or at least 9.0 reduces the concentration of methyl mercaptan. In some embodiments, fermentation in a neutral environment reduces the concentration of methyl mercaptan. In some embodiments, fermentation in an environment having a pH of 7.5 or below reduces the concentration of methyl mercaptan. In some embodiments, fermentation in an environment having a pH below 7.5 reduces the concentration of methyl mercaptan. In some embodiments, fermentation in an environment having a pH of 5.0 to 7.5, 5.5 to 7.5, 6.0 to 7.5, 6.5 to 7.5, or 7.0 to 7.5 reduces the concentration of methyl mercaptan. In some embodiments, fermentation in an environment having a pH of at most 7.0, at most 6.5, or at most 6.0 reduces the concentration of methyl mercaptan.

In some embodiments, fermentation reduces the concentration of dimethyl sulfide by at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90% or at least 95%. In some embodiments, fermentation reduces the concentration of dimethyl sulfide by 5-10%, 10-20%, 20-30%, 30-40%, 40-50%, 50-60%, 60-70%, 70-80%, 80-90%, or 90-100%. In some embodiments, fermentation reduces the concentration of dimethyl sulfide by 5-95%, 5-90%, 5-80%, 5-70%, 5-60%, 5-50%, 5-40%, 5-30%, 5-25%, 5-20%, 5-15%, or 5-10%. In some embodiments, fermentation reduces the concentration of dimethyl sulfide by 5-99%, 10-99%, 15-99%, 20-99%, 25-99%, 30-99%, 40-99%, 50-99%, 60-99%, 70-99%, 80-99%, or 90-99%.

In some embodiments, fermentation in an alkaline environment reduces the concentration of dimethyl sulfide. In some embodiments, fermentation in an environment having a pH greater than 7.5 reduces the concentration of dimethyl sulfide. In some embodiments, fermentation in an environment having a pH of at least 7.5 reduces the concentration of dimethyl sulfide. In some embodiments, fermentation in an environment having a pH of 7.5 to 9.0, 7.5 to 8.5, or 7.5 to 8.0 reduces the concentration of dimethyl sulfide. In some embodiments, fermentation in an environment having a pH of at least 8.0, at least 8.5, or at least 9.0 reduces the concentration of dimethyl sulfide. In some embodiments, fermentation in a neutral environment reduces the concentration of dimethyl sulfide. In some embodiments, fermentation in an environment having a pH of 7.5 or below reduces the concentration of dimethyl sulfide. In some embodiments, fermentation in an environment having a pH below 7.5 reduces the concentration of dimethyl sulfide. In some embodiments, fermentation in an environment having a pH of 5.0 to 7.5, 5.5 to 7.5, 6.0 to 7.5, 6.5 to 7.5, or 7.0 to 7.5 reduces the concentration of dimethyl sulfide. In some embodiments, fermentation in an environment having a pH of at most 7.0, at most 6.5, or at most 6.0 reduces the concentration of dimethyl sulfide.

Not all bacterial strains of a bacterial mixture must reduce the concentration of VSCs, as some bacterial strains may (i) inhibit VSC production by other microorganisms; (ii) enhance the ability of VSC concentration reduction other strains of the mixture; and/or (iii) reduce the pH of the oral microenvironment. Accordingly, in some embodiments, one or more bacterial strains of a bacterial mixture (e.g., in a composition, nutritional supplement, dental supplement, or food product) described herein inhibits VSC production by another microorganism. In some embodiments, one or more bacterial strains of a bacterial mixture enhances the ability of another bacterial strain to reduce VSC concentration. In some embodiments, one or more bacterial strains of a bacterial mixture reduces the pH of an oral microenvironment of a subject.

In some embodiments, one or more bacterial strains of a mixture inhibit production of VSCs by *Porphyromonas gingivalis*. In some embodiments, one or more bacterial strains of a mixture inhibit production of VSCs by *Prevotella intermedia*. In some embodiments, one or more bacterial strains of a mixture inhibit production of VSCs by *Porphyromonas canigingivalis*. In some embodiments, one or more bacterial strains of a mixture inhibit production of VSCs by *Tannerella forsythia*. In some embodiments, one or more bacterial strains of a mixture inhibit production of VSCs by *Treponema denticola*. In some embodiments, one or more bacterial strains of a mixture inhibit production of VSCs by *Fusobacterium nucleatum*.

In some embodiments, one or more bacterial strains of a mixture inhibit production of hydrogen sulfide by *Porphyromonas gingivalis*. In some embodiments, one or more bacterial strains of a mixture inhibit production of hydrogen sulfide by *Prevotella intermedia*. In some embodiments, one or more bacterial strains of a mixture inhibit production of hydrogen sulfide by *Porphyromonas canigingivalis*. In some embodiments, one or more bacterial strains of a mixture inhibit production of hydrogen sulfide by *Tannerella forsythia*. In some embodiments, one or more bacterial strains of a mixture inhibit production of hydrogen sulfide by *Treponema denticola*. In some embodiments, one or more bacterial strains of a mixture inhibit production of hydrogen sulfide by *Fusobacterium nucleatum*.

In some embodiments, one or more bacterial strains of a mixture inhibit production of methyl mercaptan by *Porphyromonas gingivalis*. In some embodiments, one or more bacterial strains of a mixture inhibit production of methyl mercaptan by *Prevotella intermedia*. In some embodiments, one or more bacterial strains of a mixture inhibit production of methyl mercaptan by *Porphyromonas canigingivalis*. In some embodiments, one or more bacterial strains of a mixture inhibit production of methyl mercaptan by *Tannerella forsythia*. In some embodiments, one or more bacterial strains of a mixture inhibit production of methyl mercaptan by *Treponema denticola*. In some embodiments, one or more bacterial strains of a mixture inhibit production of methyl mercaptan by *Fusobacterium nucleatum*.

In some embodiments, one or more bacterial strains of a mixture inhibit production of dimethyl sulfide by *Porphyromonas gingivalis*. In some embodiments, one or more bacterial strains of a mixture inhibit production of dimethyl sulfide by *Prevotella intermedia*. In some embodiments, one or more bacterial strains of a mixture inhibit production of dimethyl sulfide by *Porphyromonas canigingivalis*. In some embodiments, one or more bacterial strains of a mixture inhibit production of dimethyl sulfide by *Tannerella forsythia*. In some embodiments, one or more bacterial strains of a mixture inhibit production of dimethyl sulfide by *Treponema denticola*. In some embodiments, one or more bacterial strains of a mixture inhibit production of dimethyl sulfide by *Fusobacterium nucleatum*.

In some embodiments, one or more bacterial strains produces an organic acid. Non-limiting examples of organic acids include lactic acid, ascorbic acid, acetic acid, acrylic acid, propionic acid, pyruvic acid, and citric acid.

In some embodiments, fermentation by a bacterial strain or bacterial mixture produces lactic acid. In some embodiments, fermentation by a bacterial strain or bacterial mixture produces ascorbic acid. In some embodiments, fermentation by a bacterial strain or bacterial mixture produces acetic acid. In some embodiments, fermentation by a bacterial strain or bacterial mixture produces acrylic acid. In some embodiments, fermentation by a bacterial strain or bacterial mixture produces propionic acid. In some embodiments, fermentation by a bacterial strain or bacterial mixture produces pyruvic acid. In some embodiments, fermentation by a bacterial strain or bacterial mixture produces citric acid. In some embodiments, fermentation by a bacterial strain or bacterial mixture produces one or more organic acids in a concentration sufficient to increase the H+ ion concentration in a medium by 1.5-fold, 2.0-fold, 2.5-fold, 3.0-fold, 3.16-fold, 3.17-fold, 3.5-fold, 4.0-fold, 5.0-fold, 6.0-fold, 7.0-fold, 8.0-fold, 8.5-fold, 9.0-fold, 10-fold, 15-fold, 20-fold, 25-fold, 30-fold, 31-fold, 32-fold, 40-fold, 50-fold, 60-fold, 70-fold, 80-fold, 90-fold, or 100-fold. In some embodiments, fermentation by a bacterial strain or bacterial mixture produces one or more organic acids in a concentration sufficient to reduce the pH of a medium by at least 0.5, at least 1.0, at least 1.5, or at least 2.0. In some embodiments, fermentation by a bacterial strain or bacterial mixture produces one or more organic acids in a concentration sufficient to reduce the pH of a medium below 7.5.

In some embodiments, fermentation by a bacterial strain or bacterial mixture produces lactic acid in a concentration sufficient to increase the H+ ion concentration in a medium by 1.5-fold, 2.0-fold, 2.5-fold, 3.0-fold, 3.16-fold, 3.17-fold, 3.5-fold, 4.0-fold, 5.0-fold, 6.0-fold, 7.0-fold, 8.0-fold, 8.5-fold, 9.0-fold, 10-fold, 15-fold, 20-fold, 25-fold, 30-fold, 31-fold, 32-fold, 40-fold, 50-fold, 60-fold, 70-fold, 80-fold, 90-fold, or 100-fold. In some embodiments, fermentation by a bacterial strain or bacterial mixture produces lactic acid in a concentration sufficient to reduce the pH of a medium by at least 0.5, at least 1.0, at least 1.5, or at least 2.0. In some embodiments, fermentation by a bacterial strain or bacterial mixture produces lactic acid in a concentration sufficient to reduce the pH of a medium below 7.5.

In some embodiments, fermentation by a bacterial strain or bacterial mixture produces ascorbic acid in a concentration sufficient to increase the H+ ion concentration in a medium by 1.5-fold, 2.0-fold, 2.5-fold, 3.0-fold, 3.16-fold, 3.17-fold, 3.5-fold, 4.0-fold, 5.0-fold, 6.0-fold, 7.0-fold, 8.0-fold, 8.5-fold, 9.0-fold, 10-fold, 15-fold, 20-fold, 25-fold, 30-fold, 31-fold, 32-fold, 40-fold, 50-fold, 60-fold, 70-fold, 80-fold, 90-fold, or 100-fold. In some embodiments, fermentation by a bacterial strain or bacterial mixture produces ascorbic acid in a concentration sufficient to reduce the pH of a medium by at least 1.0, at least 1.5, or at least 2.0. In some embodiments, fermentation by a bacterial strain or bacterial mixture produces ascorbic acid in a concentration sufficient to reduce the pH of a medium below 7.5.

In some embodiments, fermentation by a bacterial strain or bacterial mixture produces acetic acid in a concentration sufficient to increase the H+ ion concentration in a medium by 1.5-fold, 2.0-fold, 2.5-fold, 3.0-fold, 3.16-fold, 3.17-fold, 3.5-fold, 4.0-fold, 5.0-fold, 6.0-fold, 7.0-fold, 8.0-fold, 8.5-fold, 9.0-fold, 10-fold, 15-fold, 20-fold, 25-fold, 30-fold, 31-fold, 32-fold, 40-fold, 50-fold, 60-fold, 70-fold, 80-fold, 90-fold, or 100-fold. In some embodiments, fermentation by a bacterial strain or bacterial mixture produces acetic acid in a concentration sufficient to reduce the pH of a medium by at least 0.5, at least 1.0, at least 1.5, or at least 2.0. In some embodiments, fermentation by a bacterial strain or bacterial mixture produces acetic acid in a concentration sufficient to reduce the pH of a medium below 7.5.

In some embodiments, fermentation by a bacterial strain or bacterial mixture produces acrylic acid in a concentration sufficient to increase the H+ ion concentration in a medium by 1.5-fold, 2.0-fold, 2.5-fold, 3.0-fold, 3.16-fold, 3.17-fold, 3.5-fold, 4.0-fold, 5.0-fold, 6.0-fold, 7.0-fold, 8.0-fold, 8.5-fold, 9.0-fold, 10-fold, 15-fold, 20-fold, 25-fold, 30-fold, 31-fold, 32-fold, 40-fold, 50-fold, 60-fold, 70-fold, 80-fold, 90-fold, or 100-fold. In some embodiments, fermentation by a bacterial strain or bacterial mixture produces acrylic acid in a concentration sufficient to reduce the pH of a medium by at least 0.5, at least 1.0, at least 1.5, or at least 2.0. In some embodiments, fermentation by a bacterial strain or bacterial mixture produces acrylic acid in a concentration sufficient to reduce the pH of a medium below 7.5.

In some embodiments, fermentation by a bacterial strain or bacterial mixture produces propionic acid in a concentration sufficient to increase the H+ ion concentration in a medium by 1.5-fold, 2.0-fold, 2.5-fold, 3.0-fold, 3.16-fold, 3.17-fold, 3.5-fold, 4.0-fold, 5.0-fold, 6.0-fold, 7.0-fold, 8.0-fold, 8.5-fold, 9.0-fold, 10-fold, 15-fold, 20-fold, 25-fold, 30-fold, 31-fold, 32-fold, 40-fold, 50-fold, 60-fold, 70-fold, 80-fold, 90-fold, or 100-fold. In some embodiments, fermentation by a bacterial strain or bacterial mixture produces propionic acid in a concentration sufficient to reduce the pH of a medium by at least 0.5, at least 1.0, at least 1.5, or at least 2.0. In some embodiments, fermentation by a bacterial strain or bacterial mixture produces propionic acid in a concentration sufficient to reduce the pH of a medium below 7.5.

In some embodiments, fermentation by a bacterial strain or bacterial mixture produces pyruvic acid in a concentration sufficient to increase the H+ ion concentration in a medium by 1.5-fold, 2.0-fold, 2.5-fold, 3.0-fold, 3.16-fold, 3.17-fold, 3.5-fold, 4.0-fold, 5.0-fold, 6.0-fold, 7.0-fold, 8.0-fold, 8.5-fold, 9.0-fold, 10-fold, 15-fold, 20-fold, 25-fold, 30-fold, 31-fold, 32-fold, 40-fold, 50-fold, 60-fold, 70-fold, 80-fold, 90-fold, or 100-fold. In some embodiments, fermentation by a bacterial strain or bacterial mixture produces pyruvic acid in a concentration sufficient to reduce the pH of a medium by at least 0.5, at least 1.0, at least 1.5, or at least 2.0. In some embodiments, fermentation by a bacterial strain or bacterial mixture produces pyruvic acid in a concentration sufficient to reduce the pH of a medium below 7.5.

In some embodiments, fermentation by a bacterial strain or bacterial mixture produces citric acid in a concentration sufficient to increase the H+ ion concentration in a medium by 1.5-fold, 2.0-fold, 2.5-fold, 3.0-fold, 3.16-fold, 3.17-fold, 3.5-fold, 4.0-fold, 5.0-fold, 6.0-fold, 7.0-fold, 8.0-fold, 8.5-fold, 9.0-fold, 10-fold, 15-fold, 20-fold, 25-fold, 30-fold, 31-fold, 32-fold, 40-fold, 50-fold, 60-fold, 70-fold, 80-fold, 90-fold, or 100-fold. In some embodiments, fermentation by a bacterial strain or bacterial mixture produces citric acid in a concentration sufficient to reduce the pH of a medium by at least 0.5, at least 1.0, at least 1.5, or at least 2.0. In some embodiments, fermentation by a bacterial strain or bacterial mixture produces citric acid in a concentration sufficient to reduce the pH of a medium below 7.5. Any suitable method may be used to measure organic acid concentrations, organic acid production, and pH, such as methods of analysis known in the art, before, during, and/or after bacterial fermentation.

The bacterial strains of the bacterial mixture are preferably in a live (e.g., viable) state or in a mixture of live and inactivated (e.g., killed, not viable) states. As will be appreciated by one of ordinary skill in the art, bacterial cells may be considered live or living if the cells are metabolically active, e.g., have a detectable level of metabolic activity. Being metabolically active does not require proliferation or replication of the cells. Methods of evaluating whether a bacterial strain is living and is metabolically active are known in the art, for example, viability assays, detection of ATP measurements, membrane potential, respiratory activity, uptake of dyes. See, e.g., Emerson et al. *Microbiome* (2017) 5:86. In some embodiments, one or more of the bacterial strains of the bacterial mixture are in a live state and maintain viability in the composition, nutritional supplement, dental supplement, or food product, for example following production and/or storage conditions.

In some embodiments, at least one (e.g., 1, 2, 3, 4, 5, 6, 7, 8, 9, or 10) of the bacterial strains in the composition is a spore-former. In some embodiments, at least one (e.g., 1, 2, 3, 4, 5, 6, 7, 8, 9, or 10) of the bacterial strains in the composition is in spore form. In some embodiments, at least one (e.g., 1, 2, 3, 4, 5, 6, 7, 8, 9, or 10) of the bacterial strains in the composition is a non-spore former. In some embodiments, at least one (e.g., 1, 2, 3, 4, 5, 6, 7, 8, 9, or 10) of the bacterial strains in the composition is in vegetative form. As discussed above, spore forming bacteria can also be in vegetative form. In some embodiments, at least one (e.g., 1, 2, 3, 4, 5, 6, 7, 8, 9, or 10) of the bacterial strains in the composition is in spore form and at least one (e.g., 1, 2, 3, 4, 5, 6, 7, 8, 9, or 10) of the bacterial strains in the composition is in vegetative form. In some embodiments, at least one bacterial strain that is considered able to form spores (i.e., a spore-former) but is present in the composition in vegetative form. In some embodiments, at least one bacterial strain that is considered able to form spores is present in the composition both in spore form and in vegetative form. In some embodiments, each of the bacterial strains is in vegetative form.

It is envisioned that the bacterial strains of the compositions described herein are alive and will be alive when they reach the target area (e.g., the intestines). Bacterial spores are considered to be alive in this regard. In some embodiments, bacteria that are administered as spores may germinate in the target area (e.g., the intestines). It should further be appreciated that not all of the bacteria are alive and the compositions can include a percentage (e.g., by weight) that is not alive. In addition, in some embodiments, the compositions include bacterial strains that are not alive when administered or at the time when the composition reaches the target area (e.g., the intestines). It is envisioned that non-living bacteria may still be useful by providing some nutrients and metabolites for the other bacterial strains in the composition.

In some embodiments, the bacterial strains of the bacterial mixture provided herein are in vegetative form, meaning the bacterial cells are not actively growing and/or reproducing. In some embodiments, at least one (e.g., 1, 2, 3, 4, 5, or more) of the bacterial strains of the bacterial mixture is in vegetative form. In some embodiments, each of the bacterial strains of the bacterial mixture is in vegetative form. It will be appreciated that live bacterial strains may be viable but may not be actively growing/replicating. For example, following utilization of the sugar source in a fermentation medium, bacterial strains may slow or halt active replication due to reduced levels of available nutrients.

In some embodiments, bacterial strains of the bacterial communities provided herein are living and are alive in the composition, nutritional supplement, dental supplement, or food product. Viability can be determined by quantifying the colony forming units (CFU), for example by plating a sample of the bacterial community, or composition, nutritional supplement, dental supplement, or food product, on a nutritive agar medium. The number of colony forming units corresponds to the number of viable bacterial cells in the sample tested such as the community or composition, nutritional supplement, dental supplement, or food product.

The bacterial strains described herein may be obtained from or derived from any source known in the art, such as from a food source or an environmental source (e.g., soil). As used herein, the term "derived from" in the context of bacterial strains derived from a particular source refers to obtaining a bacterial strain from the source, which may involve isolating and/or propagating cells of a bacterial strain. In some embodiments, the bacterial strains are further manipulated, such as purified and/or analyzed, prior to use in the compositions nutritional supplements, dental supplements, and/or food products and methods described herein. As will be evident to one of ordinary skill in the art, reference to a bacterial strain or cells of a bacterial strain that is derived from a particular source encompasses progeny cells thereof.

The bacterial strains of the bacterial community may be derived from a fermented food or beverage, such as cultured milk and yogurt, natto, cheese, kombucha, wine, beer, cider, miso, kimchi, sauerkraut, fermented sausage, among others. Additionally, bacterial strains may be derived from cultured plants or plant protein isolates, including plants or proteins isolated from cereal grains (e.g., oats), oil seeds (e.g., sunflower seeds), legumes, pulses, beans, broad beans, faba beans, peas, chickpeas, cow peas, pigeon peas, lentils, Bambara beans, vetches, and lupins.

In some embodiments, one or more bacterial strains are derived from a fermented meat. In some embodiments, one or more bacterial strains are derived from salami. In some embodiments, one or more bacterial strain are derived from a fermented vegetable mix. In some embodiments, one or more bacterial strains are derived from kimchi.

In some embodiments, at least one bacterial strain of the bacterial mixture may be purified. In some embodiments, at least one bacterial strain of the bacterial mixture may be isolated. Any of the bacterial strains described herein may be isolated and/or purified, for example, from a source such as a food source (e.g., a fermented food or beverage product) or an environmental source.

In any of the compositions described herein, including nutritional supplements, dental supplements, and/or food products comprising bacterial strains, the bacterial strains may be in any form, for example in an aqueous form, such as a solution or a suspension, embedded in a semi-solid form, in a powdered form, or freeze-dried form. In some embodiments, the bacterial strains are in powder form. Powder is a dry, bulk solid comprised of many discrete, solid, macroscopic particles, which may flow freely when the powder (or a container in which the powder is present) is shaken or tilted. The skilled artisan will appreciate that powder may be incorporated into a composition (e.g., with a carrier and in a defined form), where the composition as a whole has a solid form that is not a powder.

Any suitable method may be used to convert a bacterial strains to powder form. Non-limiting examples of powder production processes include grinding and agglomeration (e.g., of bacteria in a solid or semi-solid state, such as a lyophilized cake), spray drying (e.g., of bacteria in liquid suspension). Advantages of preparing bacteria in powder form include, without limitation, ease of incorporation into a product intended for consumption (e.g., nutritional supplement or food product intended for ingestion or dental supplement intended for chewing), distribution throughout a product to limit the bacterial mixture's effect on taste and texture, and reduction of water activity to improve stability of desired components of a bacterial mixture. Where a fermentate is lyophilized and in powder form, powder may be lyophilized, or a lyophilized non-powder solid may be made into a powder form (e.g., by grinding and/or agglomeration).

In some embodiments, a bacterial mixture in powder form has a water content of 10% or less, 9% or less, 8% or less, 7% or less, 6% or less, 5% or less, 4% or less, 3% or less, 2% or less, or 1% or less.

In some embodiments, the bacterial strains are lyophilized or spray-dried. In some embodiments, at least one bacterial strain of the bacterial mixture is in a lyophilized form. In some embodiments, each of bacterial strains of the bacterial mixture is in a lyophilized form. In some embodiments, the composition or the bacterial strains are lyophilized. In some embodiments, a subset of the bacterial strains is lyophilized. In some embodiments, each of the bacterial strains are lyophilized. Methods of lyophilizing compositions, specifically compositions comprising bacteria, are known in the art. See, e.g., U.S. Pat. Nos. 3,261,761; 4,205,132; and PCT Publication Nos. WO 2014/029578 and WO 2012/098358, herein incorporated by reference in their entirety. The bacteria may be lyophilized as a combination and/or the bacteria may be lyophilized separately and combined prior to incorporation into a composition, nutritional supplement, dental supplement, or food product. A bacterial strain may be combined with a nutrient or carrier prior to combining it with the other bacterial strain or multiple lyophilized bacteria may be combined while in lyophilized form and the mixture of bacteria, once combined may subsequently be combined with a nutrient and/or excipient. In some embodiments, the bacterial strain is a lyophilized cake. In some embodiments, the compositions comprising the one or more bacterial strains are a lyophilized cake. In such embodiments, the bacterial strain(s) may be rehydrated or suspended and/or cultured prior to use in the methods described herein. In some embodiments, the bacterial strain(s) in lyophilized form are used directly, for example, without rehydrating or suspension (e.g., directly added to a medium).

In some embodiments, one of or more of the bacterial strains of the compositions has been spray-dried. The process of spray-drying refers to production of a dry powder from a liquid comprising bacterial compositions. (See, e.g., Ledet et al., Spray-Drying of Pharmaceuticals in "*Lyophilized Biologics and Vaccines*" pages 273-194, Springer). In general, the process involves rapidly drying the bacterial compositions with a hot gas. A bacterial strain may be combined with an excipient or nutrient prior to combining it with the other bacterial strains or multiple spray-dried bacterial strains may be combined while in spray-dried form and the mixture of bacterial strains, once combined, may be subsequently combined with an excipient, carrier, or nutrient.

In some embodiments, the compositions comprising bacterial strains are formulated for oral delivery.

The bacterial strains can be manufactured using fermentation techniques well known in the art. In some embodiments, the bacteria are propagated or manufactured using liquid fermenters, which can support the rapid growth of bacterial species. The fermenters may be, for example, stirred tank reactors or disposable wave bioreactors. Culture media such as BL media and EG media, or similar versions of these media, can be used to support the growth of the bacterial species. The bacterial product can be purified and concentrated from the fermentation broth by traditional techniques, such as centrifugation and filtration, and can optionally be dried and lyophilized by techniques well known in the art.

In some embodiments, the bacterial strains can be manufactured using fermentation techniques and conditions to promote the formation of bacterial spores or enhance the formation of bacterial spores. Methods of enhancing spore formation and yield are known in the art and include, for example, medium compositions, such as particular carbon sources (e.g., rice straw hydrolase), sodium chloride, peptone, yeast extract, ammonium phosphate; oxygen supply; growth temperature; and drying methods (e.g., hot air drying, vacuum freeze drying). See, e.g., Yin et al. *Lett. Appl. Microbiol.* (2021) 72(2): 149-156; Penna et al. *PDA J. Pharm. Sci. Technol.* (1998) 52(5): 198-208; Boniolo et al. *Appl. Micrbiol. Biotechnol.* (2012) 94(3): 625-36; Li et al. *Front. Nutr.* (2022) 9:1025248; Li et. Al. *J. Ind. Microbiol. Biotechnol.* (2022) 49(4); Petrillo et al. *Microb. Cell Fact.* (2020) 19(1): 185; and Tavares et al. *Curr. Microbiol.* (2013) 66(3): 279-85; each of which is incorporated by reference herein.

As used herein, the term "isolated" refers to a bacterial cell or bacterial strain that has been separated from one or more undesired components, such as other bacterial cells or bacterial strains, one or more components of a growth medium, one or more components of a food or beverage product. In some embodiments, the bacterial strains are substantially isolated from a source such that other components of the source are not detected. In some embodiments, a bacterial strain is isolated or purified from a sample and then cultured (grown, propagated) under the appropriate conditions for replication. The bacterial strain that is grown under appropriate conditions for replication can subsequently be isolated/purified from the culture in which it is grown.

Also within the scope of the present disclosure are isolated bacterial communities. In this context, the term "isolated" refers to a bacterial community that has been separated from one or more undesired component, such as other bacterial cells, bacterial strains, bacterial communities, one or more component of a growth medium, one or more component of a food or beverage product, and/or one or more component of a sample, such as an environmental sample. In some embodiments, the bacterial communities are substantially isolated from a source such that other components of the source are not detected. In some embodiments, bacterial strains are individually cultured and then combined forming the bacterial community. In some embodiments, the bacterial strains are combined forming a bacterial community, which is then cultured (grown, propagated) collectively, as a community under the appropriate conditions for replication. The bacterial strain that is grown under appropriate conditions for replication can subsequently be isolated/purified from the culture in which it is grown.

The specific bacterial strains selected and combined to form the bacterial communities described herein may have beneficial properties when present or used in combination, as compared to bacterial communities that contain different combinations of bacterial strains or to bacterial strains alone (not in combination). For example, the bacterial communities, when compared to single strains or other bacterial communities, cause a reduction in VSC abundance that is at least 1.1-fold, 1.2-fold, 1.3-fold, 1.4-fold, 1.5-fold, 2-fold, 3-fold, 4-fold, 5-fold, 6-fold, 7-fold, 8-fold, 9-fold, 10-fold, 20-fold, 30-fold, 40-fold, or up to 50-fold higher than a bacterial community containing a different combination of bacterial strains or the bacterial strains when present or used alone under similar fermentation conditions. In some embodiments, the bacterial community cause a reduction in VSC abundance that is about 1.5-5-fold higher than a bacterial community containing a different combination of bacterial strains or the bacterial strains when present or used alone under similar fermentation conditions.

In some embodiments, the bacterial communities described herein, when compared to single strains or other bacterial communities, may replicate more quickly and reach a higher biomass during fermentation. In some embodiments, the bacterial communities described herein replicate at a rate that is at least 1.1-fold, 1.2-fold, 1.3-fold, 1.4-fold, 1.5-fold, 2-fold, 3-fold, 4-fold, 5-fold, 6-fold, 7-fold, 8-fold, 9-fold, 10-fold, 20-fold, 30-fold, 40-fold, or up to 50-fold higher than a bacterial community containing a different combination of bacterial strains or the bacterial strains when present or used alone under similar fermentation conditions. In some embodiments, the bacterial communities described herein replicate at a rate that is about 2-3-fold higher than a bacterial community containing a different combination of bacterial strains or the bacterial strains when present or used alone under similar fermentation conditions.

In some embodiments, the bacterial communities described herein reach a biomass that is at least 1.1-fold, 1.2-fold, 1.3-fold, 1.4-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 100-fold, 200-fold, 300-fold, 400-fold or up to 500-fold higher than the biomass that can be reached with a bacterial community containing a different combination of bacterial strains or with a bacterial strain alone under similar fermentation conditions. In some embodiments, the bacterial communities described herein reach a biomass that is about 5-10-fold higher than the biomass that can be reached with a bacterial community containing a different combination of bacterial strains or with a bacterial strain alone under similar fermentation conditions.

Any suitable method of assessing bacterial replication and/or quantifying biomass may be used. Exemplary methods of assessing the replication rate of a bacterial strain or community thereof, as well as methods of quantifying biomass, are known in the art. See, e.g., Brown et al., *Nature Biotechnology* (2016) 34: 1256-1263.

As another example, the bacterial communities described herein may ferment more quickly than other bacterial communities or than single bacterial strains used alone. The rate of fermentation of a bacterial community and/or individual strain can be assessed by any suitable method, such as the utilization of a sugar source, level of a sugar in the fermentation medium, change in pH of the medium, generation of a fermentation product (e.g., organic acids, $CO_2$). In some embodiments, the bacterial communities described herein ferment at a rate that is at least 1.1-fold, 1.2-fold, 1.3-fold, 1.4-fold, 1.5-fold, 2-fold, 3-fold, 4-fold, 5-fold, 6-fold, 7-fold, 8-fold, 9-fold, 10-fold, 20-fold, 30-fold, 40-fold, or up to 50-fold higher than a bacterial community containing a different combination of bacterial strains or single bacterial strains when used alone under similar fermentation conditions. In some embodiments, the bacterial communities described herein ferment at a rate that is about 2-3-fold higher than a bacterial community containing a different combination of bacterial strains or single bacterial strains when used alone under similar fermentation conditions.

In some embodiments, the bacterial strains used in any of the bacterial mixtures described herein are preferably "generally recognized as safe" (GRAS) or approved as food additives according to the U.S. Food and Drug Administration. See, e.g., Federal Food, Drug, and Cosmetic Act, sections 201(s) and 409.

In some embodiments, the composition, nutritional supplement, dental supplement, or food product comprises about 10, about $10^2$, about $10^3$, about $10^4$, about $10^5$, about $10^6$, about $10^7$, about $10^8$, about $10^9$, about $10^{10}$, about $10^{11}$, about $10^{12}$, about $10^{13}$ or more of each of the bacterial strains per gram of the composition, nutritional supplement, dental supplement, or food product. In some embodiments, the composition, nutritional supplement, dental supplement, or food product comprises at least or about 10, at least or about $10^2$, at least or about $10^3$, at least or about $10^4$, at least or about $10^5$, at least or about $10^6$, at least or about $10^7$, at least or about $10^8$, at least or about $10^9$, at least or about $10^{10}$, at least or about $10^{11}$, at least or about $10^{12}$, at least or about $10^{13}$ or more of each of the bacterial strains per gram of the composition, nutritional supplement, dental supplement, or food product.

In some embodiments, the composition, nutritional supplement, dental supplement, or food product contains between about 10 and about $10^{13}$, between about $10^2$ and about $10^{13}$, between about $10^3$ and about $10^{13}$, between about $10^4$ and about $10^{13}$, between about $10^5$ and about $10^{13}$, between about $10^6$ and about $10^{13}$, between about $10^7$ and about $10^{13}$, between about $10^8$ and about $10^{13}$, between about $10^9$ and about $10^{13}$, between about $10^{10}$ and about $10^{13}$, between about $10^{11}$ and about $10^{13}$, between about $10^{12}$ and about $10^{13}$, between about 10 and about $10^{12}$, between about $10^2$ and about $10^{12}$, between about $10^3$ and about $10^{12}$, between about $10^4$ and about $10^{12}$, between about $10^5$ and about $10^{12}$, between about $10^6$ and about $10^{12}$, between about $10^7$ and about $10^{12}$, between about $10^8$ and about $10^{12}$, between about $10^9$ and about $10^{12}$, between about $10^{10}$ and about $10^{12}$, between about $10^{11}$ and about $10^{12}$, between about 10 and about $10^{11}$, between about $10^2$ and about $10^{11}$, between about $10^3$ and about $10^{13}$, between about $10^4$ and about $10^{13}$, between about $10^5$ and about $10^{13}$, between about $10^6$ and about $10^{13}$, between about $10^7$ and about $10^{11}$, between about $10^8$ and about $10^{11}$, between about $10^9$ and about $10^{11}$, between about $10^{10}$ and about $10^{11}$, between about 10 and about $10^{10}$, between about $10^2$ and about $10^{10}$, between about $10^3$ and about $10^{10}$, between about $10^4$ and about $10^{10}$, between about $10^5$ and about $10^{10}$, between about $10^6$ and about $10^{10}$, between about $10^7$ and about $10^{10}$, between about $10^8$ and about $10^{10}$, between about $10^9$ and about $10^{10}$, between about 10 and about $10^9$, between about $10^2$ and about $10^9$, between about $10^3$ and about $10^9$, between about $10^4$ and about $10^9$, between about $10^5$ and about $10^9$, between about $10^6$ and about $10^9$, between about $10^7$ and about $10^9$, between about $10^8$ and about $10^9$, between about 10 and about $10^8$, between about $10^2$ and about $10^8$, between about $10^3$ and about $10^8$, between about $10^4$ and about $10^8$, between about $10^5$ and about $10^8$, between about $10^6$ and about $10^8$, between about $10^7$ and about $10^8$, between about 10 and about $10^7$, between about $10^2$ and about $10^7$, between about $10^3$ and about $10^7$, between about $10^4$ and about $10^7$, between about $10^5$ and about $10^7$, between about $10^6$ and about $10^7$, between about 10 and about $10^6$, between about $10^2$ and about $10^6$, between about $10^3$ and about $10^6$, between about $10^4$ and about $10^6$, between about $10^5$ and about $10^6$, between about 10 and about $10^5$, between about $10^2$ and about $10^5$, between about $10^3$ and about $10^5$, between about $10^4$ and about $10^5$, between about 10 and about $10^4$, between about $10^2$ and about $10^4$, between about $10^3$ and about $10^4$, between about 10 and about $10^3$, between about $10^2$ and about $10^3$, or between about 10 and about $10^2$ of each of the bacterial strains per gram of composition, nutritional supplement, dental supplement, or food product. In some embodiments, the composition, nutritional supplement, dental supplement, or food product contains between $10^5$ and $10^6$ of each of the bacterial strains per gram of composition, nutritional supplement, dental supplement, or food product. In some embodiments, the composition, nutritional supplement, dental supplement, or food product contains between $10^5$ and $10^{13}$ of each of the bacterial strains per gram of composition, nutritional supplement, dental supplement, or food product. In some embodiments, the composition, nutritional supplement, dental supplement, or food product contains between $10^5$ and $10^{10}$ of each of the bacterial strains per gram of composition, nutritional supplement, dental supplement, or food product. In some embodiments, the composition, nutritional supplement, dental supplement, or food product contains between $10^6$ and $10^{10}$ of each of the bacterial strains per gram of composition, nutritional supplement, dental supplement, or food product.

Each of the bacterial strains of the bacterial mixture may be present in the same amount or in different amounts.

In some embodiments, the composition, nutritional supplement, dental supplement, or food product comprises about 10, about $10^2$, about $10^3$, about $10^4$, about $10^5$, about $10^6$, about $10^7$, about $10^8$, about $10^9$, about $10^{10}$, about $10^{11}$, about $10^{12}$, about $10^{13}$ or more total bacterial cells (CFU) of all bacterial strains per gram of composition, nutritional supplement, dental supplement, or food product. In some embodiments, the composition or nutritional supplements comprise at least 10, at least $10^2$, at least $10^3$, at least $10^4$, at least $10^5$, at least $10^6$, at least $10^7$, at least $10^8$, at least $10^9$, at least $10^{10}$, at least $10^{11}$, at least $10^{12}$, at least $10^{13}$ or more of total bacterial cells (CFU) of all bacterial strains per gram composition, nutritional supplement, dental supplement, or food product.

In some embodiments, the composition, nutritional supplement, dental supplement, or food product contains between about 10 and about $10^{13}$, between about $10^2$ and about $10^{13}$, between about $10^3$ and about $10^{13}$, between about $10^4$ and about $10^{13}$, between about $10^5$ and about $10^{13}$, between about $10^6$ and about $10^{13}$, between about $10^7$ and about $10^{13}$, between about $10^8$ and about $10^{13}$, between about $10^9$ and about $10^{13}$, between about $10^{10}$ and about $10^{13}$, between about $10^{11}$ and about $10^{13}$, between about $10^{12}$ and about $10^{13}$, between about 10 and about $10^{12}$, between about $10^2$ and about $10^{12}$, between about $10^3$ and about $10^{12}$, between about $10^4$ and about $10^{12}$, between about $10^5$ and about $10^{12}$, between about $10^6$ and about $10^{12}$, between about $10^7$ and about $10^{12}$, between about $10^8$ and about $10^{12}$, between about $10^9$ and about $10^{12}$, between about $10^{10}$ and about $10^{12}$, between about $10^{11}$ and about $10^{12}$, between about 10 and about $10^{11}$, between about $10^2$ and about $10^{11}$, between about $10^3$ and about $10^{13}$, between about $10^4$ and about $10^{13}$, between about $10^5$ and about $10^{13}$, between about $10^6$ and about $10^{13}$, between about $10^7$ and about $10^{11}$, between about $10^8$ and about $10^{11}$, between about $10^9$ and about $10^{11}$, between about $10^{10}$ and about $10^{11}$, between about 10 and about $10^{10}$, between about $10^2$ and about $10^{10}$, between about $10^3$ and about $10^{10}$, between about $10^4$ and about $10^{10}$, between about $10^5$ and about $10^{10}$, between about $10^6$ and about $10^{10}$, between about $10^7$ and about $10^{10}$, between about $10^8$ and about $10^{10}$, between about $10^9$ and about $10^{10}$, between about 10 and about $10^9$, between about $10^2$ and about $10^9$, between about $10^3$ and about $10^9$, between about $10^4$ and about $10^9$, between about $10^5$ and about $10^9$, between about $10^6$ and about $10^9$, between about $10^7$ and about $10^9$, between about $10^8$ and about $10^9$, between about 10 and about $10^8$, between about $10^2$ and about $10^8$, between about $10^3$ and about $10^8$, between about $10^4$ and about $10^8$, between about $10^5$ and about $10^8$, between about $10^6$ and about $10^8$, between about $10^7$ and about $10^8$, between about 10 and about $10^7$, between about $10^2$ and about $10^7$, between about $10^3$ and about $10^7$, between about $10^4$ and about $10^7$, between about $10^5$ and about $10^7$, between about $10^6$ and about $10^7$, between about 10 and about $10^6$, between about $10^2$ and about $10^6$, between about $10^3$ and about $10^6$, between about $10^4$ and about $10^6$, between about $10^5$ and about $10^6$, between about 10 and about $10^5$, between about $10^2$ and about $10^5$, between about $10^3$ and about $10^5$, between about $10^4$ and about $10^5$, between about 10 and about $10^4$, between about $10^2$ and about $10^4$, between about $10^3$ and about $10^4$, between about 10 and about $10^3$, between about $10^2$ and about $10^3$, or between about 10 and about $10^2$ total bacterial cells (e.g., CFU) per gram of composition, nutritional supplement, dental supplement, or food product. In some embodiments, the composition, nutritional supplement, dental supplement, or food product contains between about $10^5$ and about $10^6$ total bacterial cells (e.g., CFU) per gram of composition, nutritional supplement, dental supplement, or food product. In some embodiments, the composition, nutritional supplement, dental supplement, or food product contains between about $10^5$ and about $10^{13}$ total bacterial cells (e.g., CFU) per gram of composition, nutritional supplement, dental supplement, or food product. In some embodiments, the composition, nutritional supplement, dental supplement, or food product contains between about $10^5$ and about $10^{10}$ total bacterial cells (e.g., CFU) per gram of composition, nutritional supplement, dental supplement, or food product. In some embodiments, the composition, nutritional supplement, dental supplement, or food product contains between about $10^6$ and about $10^{10}$ total bacterial cells (e.g., CFU) per gram of composition, nutritional supplement, dental supplement, or food product. As discussed above, a bacterial strain may be present in the same amount or a different amount as compared to another bacterial strain.

ENUMERATED EMBODIMENTS

1. A composition comprising a purified bacterial mixture, the purified bacterial mixture comprising:
   (i) a bacterial strain comprising a 16S rDNA sequence with at least 97% sequence identity to the nucleic acid sequence of SEQ ID NO: 1; and
   (ii) one or more additional bacterial strains.

2. The composition of Embodiment 1, wherein the one or more additional bacterial strains are capable of
   (a) reducing the pH of an environment from 7.5 or higher to less than 7.5;
   (b) reducing the abundance of one or more volatile sulfur compounds (VSCs) in an environment having a pH of less than 7.5; and/or
   (c) enhancing the reduction in abundance of one or more VSCs by the bacterial strain of (i).

3. The composition of Embodiment 1 or 2, wherein the one or more additional bacterial strains are selected from the group consisting of
   (i) a bacterial strain comprising a 16S rDNA sequence with at least 97% sequence identity to the nucleic acid sequence of SEQ ID NO: 2;
   (ii) a bacterial strain comprising a 16S rDNA sequence with at least 97% sequence identity to the nucleic acid sequence of SEQ ID NO: 3;
   (iii) a bacterial strain comprising a 16S rDNA sequence with at least 97% sequence identity to the nucleic acid sequence of SEQ ID NO: 4;
   (iv) a bacterial strain comprising a 16S rDNA sequence with at least 97% sequence identity to the nucleic acid sequence of SEQ ID NO: 5;
   (v) a bacterial strain comprising a 16S rDNA sequence with at least 97% sequence identity to the nucleic acid sequence of SEQ ID NO: 6;
   (vi) a bacterial strain comprising a 16S rDNA sequence with at least 97% sequence identity to the nucleic acid sequence of SEQ ID NO: 7;
   (vii) a bacterial strain comprising a 16S rDNA sequence with at least 97% sequence identity to the nucleic acid sequence of SEQ ID NO: 8;
   (viii) a bacterial strain comprising a 16S rDNA sequence with at least 97% sequence identity to the nucleic acid sequence of SEQ ID NO: 9;
   (ix) a bacterial strain comprising a 16S rDNA sequence with at least 97% sequence identity to the nucleic acid sequence of SEQ ID NO: 10;
   (x) a bacterial strain comprising a 16S rDNA sequence with at least 97% sequence identity to the nucleic acid sequence of SEQ ID NO: 11;
   (xi) a bacterial strain comprising a 16S rDNA sequence with at least 97% sequence identity to the nucleic acid sequence of SEQ ID NO: 12;
   (xii) a bacterial strain comprising a 16S rDNA sequence with at least 97% sequence identity to the nucleic acid sequence of SEQ ID NO: 13;
   (xiii) a bacterial strain comprising a 16S rDNA sequence with at least 97% sequence identity to the nucleic acid sequence of SEQ ID NO: 14;
   (xiv) a bacterial strain comprising a 16S rDNA sequence with at least 97% sequence identity to the nucleic acid sequence of SEQ ID NO: 15;
   (xv) a bacterial strain comprising a 16S rDNA sequence with at least 97% sequence identity to the nucleic acid sequence of SEQ ID NO: 16; and
   (xvi) a bacterial strain comprising a 16S rDNA sequence with at least 97% sequence identity to the nucleic acid sequence of SEQ ID NO: 17.

4. The composition of any one of Embodiments 1-3, wherein the purified bacterial mixture comprises:
   a bacterial strain comprising a 16S rDNA sequence with at least 97% sequence identity to the nucleic acid sequence of SEQ ID NO: 1; and a bacterial strain comprising a 16S rDNA sequence with at least 97% sequence identity to the nucleic acid sequence of SEQ ID NO: 17.

5. The composition of any one of Embodiments 1-4, wherein the purified bacterial mixture comprises:

a bacterial strain comprising a 16S rDNA sequence with at least 97% sequence identity to the nucleic acid sequence of SEQ ID NO: 1;

a bacterial strain comprising a 16S rDNA sequence with at least 97% sequence identity to the nucleic acid sequence of SEQ ID NO: 2; and a bacterial strain comprising a 16S rDNA sequence with at least 97% sequence identity to the nucleic acid sequence of SEQ ID NO: 3.

6. The composition of any one of Embodiments 1-5, wherein the purified bacterial mixture further comprises *Shouchella clausii, Bacillus amyloliquefaciens, Bacillus licheniformis, Bacillus pumilus, Bacillus subtilis, Bifidobacterium adolescentis, Bifidobacterium animalis, Bifidobacterium bifidum, Bifidobacterium longum, Bifidobacterium longum* subsp. *infantis, Bifidobacterium thermophilum, Enterococcus faecium, Enterococcus lactis, Lacticaseibacillus casei, Lactiplantibacillus plantarum, Lactobacillus acidophilus, Lactobacillus delbrueckii, Lactobacillus helveticus, Lactococcus cremoris, Lactococcus lactis, Latilactobacillus curvatus, Lentilactobacillus buchneri, Leuconostoc mesenteroides, Levilactobacillus brevis, Ligilactobacillus animalis, Limosilactobacillus fermentum, Limosilactobacillus reuteri, Pediococcus acidilactici, Pediococcus damnosus, Pediococcus pentosaceus, Acidipropionibacterium acidipropionici, Propionibacterium freudenreichii, Propionibacterium freudenreichii* subsp. *shermanii, Streptococcus thermophilus, Streptococcus salivarius, Weizmannia coagulans,* and/or *Weissella cibaria.*

7. The composition of any one of Embodiments 1-6, further comprising an antioxidant.

8. The composition of Embodiment 7, wherein the antioxidant is selected from the group consisting of a vitamin, an organic acid, a polyphenol, an indole-containing compound, and a phenol.

9. A composition comprising a purified bacterial strain comprising a 16S rDNA sequence with at least 97% sequence identity to the nucleic acid sequence of SEQ ID NO: 1; and an antioxidant.

10. The composition of Embodiment 9, wherein the antioxidant is selected from the group consisting of a vitamin, an organic acid, a polyphenol, an indole-containing compound, and a phenol.

11. A composition comprising a purified bacterial mixture, the purified bacterial mixture comprising:

(i) a bacterial strain belonging to *Pediococcus pentosaceus*; and (ii) one or more additional bacterial strains.

12. The composition of Embodiment 11, wherein the one or more additional bacterial strains are capable of (a) reducing the pH of an environment from 7.5 or higher to less than 7.5;

(b) reducing the abundance of one or more volatile sulfur compounds (VSCs) in an environment having a pH of less than 7.5; and/or (c) enhancing the reduction in abundance of one or more VSCs by the bacterial strain of (i).

13. The composition of Embodiment 11 or 12, wherein the purified bacterial mixture further comprises one or more bacterial strains selected from:

(i) a first bacterial strain belonging to *Lactiplantibacillus plantarum;*

(ii) a second bacterial strain belonging to *Lactiplantibacillus plantarum,* wherein the first and second bacterial strains belonging to *Lactiplantibacillus plantarum* are different bacterial strains;

(iii) a bacterial strain belonging to *Latilactobacillus curvatus;*

(iv) a bacterial strain belonging to *Limosilactobacillus fermentum;*

(v) a bacterial strain belonging to *Leuconostoc mesenteroides;*

(vi) a bacterial strain belonging to *Lactobacillus acidophilus;*

(vii) a bacterial strain belonging to *Enterococcus faecium;*

(viii) a bacterial strain belonging to *Bacillus subtilis;*

(ix) a bacterial strain belonging to *Bacillus pumilus;*

(x) a bacterial strain belonging to *Bacillus licheniformis;*

(xi) a bacterial strain belonging to *Bacillus amyloliquefaciens;*

(xii) a bacterial strain belonging to *Weizmannia coagulans;*

(xiii) a bacterial strain belonging to *Weissella cibaria;*

(xiv) a bacterial strain belonging to *Streptococcus salivarius;*

(xv) a bacterial strain belonging to *Lactococcus lactis;* and (xvi) a second bacterial strain belonging to *Pediococcus pentosaceus.*

14 The composition of any one of Embodiments 11-13, wherein the purified bacterial mixture further comprises *Shouchella clausii, Bacillus amyloliquefaciens, Bacillus licheniformis, Bacillus pumilus, Bacillus subtilis, Bifidobacterium adolescentis, Bifidobacterium animalis, Bifidobacterium bifidum, Bifidobacterium longum, Bifidobacterium longum* subsp. *infantis, Bifidobacterium thermophilum, Enterococcus faecium, Enterococcus lactis, Lacticaseibacillus casei, Lactiplantibacillus plantarum, Lactobacillus acidophilus, Lactobacillus delbrueckii, Lactobacillus helveticus, Lactococcus cremoris, Lactococcus lactis, Latilactobacillus curvatus, Lentilactobacillus buchneri, Leuconostoc mesenteroides, Levilactobacillus brevis, Ligilactobacillus animalis, Limosilactobacillus fermentum, Limosilactobacillus reuteri, Pediococcus acidilactici, Pediococcus damnosus, Pediococcus pentosaceus, Propionibacterium acidipropionici, Propionibacterium freudenreichii, Propionibacterium freudenreichii* subsp. *shermanii, Streptococcus thermophilus, Streptococcus salivarius, Weizmannia coagulans,* and/or *Weissella cibaria.*

15. The composition of any one of Embodiments 11-14, wherein the purified bacterial mixture comprises a first bacterial strain belonging to *Pediococcus pentosaceus*; and a second bacterial strain belonging to *Pediococcus pentosaceus.*

16. The composition of any one of Embodiments 11-14, wherein the purified bacterial mixture comprises:

a bacterial strain belonging to *Pediococcus pentosaceus;* a first bacterial strain belonging to *Lactiplantibacillus plantarum*; and a second bacterial strain belonging to *Lactiplantibacillus plantarum.*

17. The composition of any one of Embodiments 11-16, further comprising an antioxidant.

18. The composition of Embodiment 17, wherein the antioxidant is selected from the group consisting of a vitamin, an organic acid, a polyphenol, an indole-containing compound, and a phenol.

19. A composition comprising a purified bacterial strain belonging to *Pediococcus pentosaceus* and an antioxidant.

20. The composition of Embodiment 19, wherein the antioxidant is selected from the group consisting of a vitamin, an organic acid, a polyphenol, an indole-containing compound, and a phenol.

21. A composition comprising a purified bacterial mixture, the purified bacterial mixture comprising:

(a) a bacterial strain that reduces the abundance of one or more volatile sulfur compounds (VSCs) in an environment having a pH of 7.5 or higher; and one or more of.

(b) a bacterial strain that reduces the pH of an environment from 7.5 or higher to less than 7.5;

(c) a bacterial strain that reduces the abundance of one or more VSCs in an environment having a pH of less than 7.5; and (d) a bacterial strain that enhances the reduction in abundance of one or more VSCs by the bacterial strain of (a).

22. The composition of Embodiment 21, wherein the bacterial strain of (a) is *Pediococcus pentosaceus*.

23. The composition of Embodiment 21 or 22, wherein the bacterial strain of (b) is *Pediococcus pentosaceus*, the bacterial strain of (c) is *Pediococcus pentosaceus*, and/or the bacterial strain of (d) is *Pediococcus pentosaceus*.

24. The composition of Embodiment 22 or 23, wherein the *Pediococcus pentosaceus* comprises a 16S rDNA sequence with at least 97% sequence identity to SEQ ID NO: 1.

25. The composition of any one of the preceding Embodiments, further comprising one or more additional bacterial strains.

26. The composition of any one of the preceding Embodiments, wherein the purified bacterial mixture further comprises 2, 3, 4, 5, 6, 7, 8, 9, 10, 11, 12, 13, 14, 15, 16, 17, 18, 19, or 20 bacterial strains.

27. The composition of any one of the preceding Embodiments, wherein the purified bacterial mixture comprises 2, 3, 4, 5, 6, 7, 8, 9, or 10 bacterial strains.

28. The composition of any one of the preceding Embodiments, wherein the composition reduces the abundance of one or more volatile sulfur compounds (VSCs) in an environment having a pH of 7.5 or higher.

29. The composition of any one of the preceding Embodiments, wherein the composition reduces the abundance of one or more volatile sulfur compounds (VSCs) in an environment having a pH less than 7.5.

30. The composition of any one of the preceding Embodiments, wherein the composition reduces the abundance of one or more volatile sulfur compounds (VSCs) in an oral microenvironment of a subject.

31. The composition of any one of Embodiments D3-D5, wherein the one or more VSCs are selected from the group consisting of hydrogen sulfide, methyl mercaptan, and dimethyl sulfide.

32. The composition of any one of the preceding Embodiments, wherein the composition treats or prevents one or more symptom of halitosis in a subject.

33. The composition of any one of the preceding Embodiments, wherein the composition reduces the abundance of one or more volatile sulfur compound (VSC)-producing microorganisms in a subject.

34. The composition of Embodiment 33, wherein the one or more VSC-producing microorganisms are selected from the group consisting of *Fusobacterium nucleatum, Prevotella intermedia, Porphyromonas canigingivalis, Porphyromonas gingivalis, Tannerella forsythia*, and *Treponema denticola*.

35. The composition of any one of the preceding Embodiments, wherein the bacterial strains are lyophilized.

36. The composition of any one of the preceding Embodiments, wherein the bacterial strains are spray-dried.

37. The composition of any one of the preceding Embodiments, wherein the composition is in a flowable powder form.

38. The composition of any one of the preceding Embodiments, wherein one or more of the bacterial strains is in spore form.

39. The composition of any one of Embodiments 1-37, wherein one or more of the bacterial strains is in vegetative form.

40. The composition of Embodiment 39, wherein each of the bacterial strains is in vegetative form.

41. The composition of any one of the preceding Embodiments, wherein each of the bacterial strains is present in an amount from $10^5$ to $10^{13}$ colony forming units (CFUs) per gram of the composition.

42. The composition of any one of the preceding Embodiments, wherein each of the bacterial strains is present in an amount from $10^5$ to $10^{10}$ colony forming units (CFUs) per gram of the composition.

43. The composition of any one of the preceding Embodiments, wherein each of the bacterial strains is present in an amount from $10^6$ to $10^{10}$ colony forming units (CFUs) per gram of the composition.

44. The composition of any one of the preceding Embodiments, further comprising an organic acid.

45. The composition of Embodiment 44, wherein the organic acid is selected from the group consisting of lactic acid, ascorbic acid, acetic acid, acrylic acid, propionic acid, pyruvic acid, and citric acid.

46. The composition of any one of the preceding Embodiments, further comprising an indole-containing compound.

47. The composition of Embodiment 46, wherein the indole-containing compound is selected from the group consisting of indoleacrylic acid, indolepropionic acid, indoleacetic acid, indole-3-carbinol, indole-3-acetamine, indolealdehyde, indolelactic acid, indolepyruvate, tryptophol, and indole.

48. The composition of any one of the preceding Embodiments, further comprising a vitamin.

49. The composition of Embodiment D22, wherein the vitamin is selected from vitamin A, vitamin C, vitamin $B_1$, $B_2$, $B_6$, $B_{12}$, vitamin $D_3$, vitamin E, and vitamin K.

50. The composition of any one of the preceding Embodiments, further comprising a polyphenol.

51. The composition of Embodiment 50, wherein the polyphenol is selected from the group consisting of green tea polyphenols, tannins, resveratrol, flavonoids, and anthrocyanins.

52. A nutritional supplement comprising the composition of any one of the preceding Embodiments, and a carrier.

53. The nutritional supplement of Embodiment 52, wherein each of the bacterial strains is present in an amount from $10^5$ to $10^{13}$ colony forming units (CFUs) per gram of the composition.

54. The nutritional supplement of Embodiment 52 or 53, wherein each of the bacterial strains is present in an amount from $10^5$ to $10^{10}$ colony forming units (CFUs) per gram of the composition.

55. The nutritional supplement of any one of Embodiments 52-54, wherein each of the bacterial strains is present in an amount from $10^6$ to $10^{10}$ colony forming units (CFUs) per gram of the composition.

56. The nutritional supplement of any one of Embodiment 52-55, wherein the nutritional supplement is a canine nutritional supplement.

57. The nutritional supplement of any one of Embodiments 52-56, wherein the nutritional supplement comprises a meat or animal-derived material.

58. The nutritional supplement of Embodiment 57, wherein the meat or animal-derived material is beef, chicken, eggs, turkey, lamb, fish, blood marrow, and/or bone marrow.

59. The nutritional supplement of any one of Embodiments 52-58, wherein the nutritional supplement comprises a grain.

60. The nutritional supplement of Embodiment 59, wherein the grain is wheat, corn, rice, oats, and/or barley.

61. The nutritional supplement of any one of Embodiments 52-60, wherein the nutritional supplement comprises a fiber.

62. The nutritional supplement of Embodiment 61, wherein the fiber is sugar beet pulp, chicory pulp, chicory, coconut endosperm fiber, wheat fiber, fructooligosaccharides, galactooligosaccharides, and/or inulin.

63. The nutritional supplement of any one of Embodiments 52-62, wherein the nutritional supplement comprises algae.

64. The nutritional supplement of Embodiment 63, wherein the algae is *Ascophyllum nodosum, Spirulina,* and/or *Fucus vesiculosus.*

65. The nutritional supplement of any one of Embodiments 52-64, wherein the nutritional supplement comprises a gelatinized starch matrix.

66. The nutritional supplement of any one of Embodiments 52-65, wherein the nutritional supplement reduces inflammation in a subject.

67. The nutritional supplement of any one of Embodiments 52-66, wherein the nutritional supplement treats or prevents a symptom associated with halitosis in a subject.

68. A method comprising administering the composition of any one of Embodiments 1-51 or the nutritional supplement of any one of Embodiments 52-67 to a subject.

69. The method of Embodiment 68, wherein the administration is oral administration.

70. The method of Embodiment 68 or 69, wherein the subject has halitosis.

71. The method of any one of Embodiments 68-70, wherein an oral microenvironment of the subject has a pH of 7.5 or higher.

72. The method of any one of Embodiments 68-71, wherein an oral microenvironment of the subject comprises one or more bacterial strains selected from *Porphyromonas gingivalis, Prevotella intermedia, Porphyromonas canigingivalis, Tannerella forsythia, Treponema denticola,* and *Fusobacterium nucleatum.*

73. The method of any one of Embodiments 68-72, wherein administration of the composition (i) reduces the abundance of one or more VSCs in an oral microenvironment of the subject;

(ii) reduces inflammation in the oral microenvironment of the subject;

(iii) reduces the abundance of gingivitis, plaque, tartar, and/or dental calculus in the subject;

(iv) reduces the abundance of one or more bacterial strains associated with the production of VSCs;

(v) reduces one or more symptom associated with halitosis; and/or (vi) improves oral health of the subject.

74. The method of any one of Embodiments 68-73, wherein the subject is a carnivore.

75. The method of any one of Embodiments 68-74, wherein the subject is a mammal.

76. The method of any one of Embodiments 68-75, wherein the subject is a domesticated animal.

77. The method of any one of Embodiments 68-76, wherein the subject is a bovine, swine, llama, alpaca, sheep, or goat.

78. The method of any one of Embodiments 68-76, wherein the subject is a dog, cat, rabbit, guinea pig, hamster, or ferret.

79. The method of Embodiment 78, wherein the subject is a dog.

EQUIVALENTS AND SCOPE

While several inventive embodiments have been described and illustrated herein, those of ordinary skill in the art will readily envision a variety of other means and/or structures for performing the function and/or obtaining the results and/or one or more of the advantages described herein, and each of such variations and/or modifications is deemed to be within the scope of the inventive embodiments described herein. More generally, those skilled in the art will readily appreciate that all parameters, dimensions, materials, and configurations described herein are meant to be exemplary and that the actual parameters, dimensions, materials, and/or configurations will depend upon the specific application or applications for which the inventive teachings is/are used. Those skilled in the art will recognize, or be able to ascertain using no more than routine experimentation, many equivalents to the specific inventive embodiments described herein. It is, therefore, to be understood that the foregoing embodiments are presented by way of example only and that, within the scope of the appended claims and equivalents thereto, inventive embodiments may be practiced otherwise than as specifically described and claimed. Inventive embodiments of the present disclosure are directed to each individual feature, system, article, material, kit, and/or method described herein. In addition, any combination of two or more such features, systems, articles, materials, kits, and/or methods, if such features, systems, articles, materials, kits, and/or methods are not mutually inconsistent, is included within the inventive scope of the present disclosure.

All definitions, as defined and used herein, should be understood to control over dictionary definitions, definitions in documents incorporated by reference, and/or ordinary meanings of the defined terms.

All references, patents and patent applications disclosed herein are incorporated by reference with respect to the subject matter for which each is cited, which in some cases may encompass the entirety of the document.

The indefinite articles "a" and "an," as used herein in the specification and in the claims, unless clearly indicated to the contrary, should be understood to mean "at least one."

The phrase "and/or," as used herein in the specification and in the claims, should be understood to mean "either or both" of the elements so conjoined, i.e., elements that are conjunctively present in some cases and disjunctively present in other cases. Multiple elements listed with "and/or" should be construed in the same fashion, i.e., "one or more" of the elements so conjoined. Other elements may optionally be present other than the elements specifically identified by the "and/or" clause, whether related or unrelated to those elements specifically identified. Thus, as a non-limiting example, a reference to "A and/or B", when used in conjunction with open-ended language such as "comprising" can refer, in some embodiments, to A only (optionally including elements other than B); in another embodiment, to B only (optionally including elements other than A); in yet another embodiment, to both A and B (optionally including other elements); etc. As used herein in the specification and in the claims, "or" should be understood to have the same meaning as "and/or" as defined above. For example, when separating items in a list, "or" or "and/or" shall be interpreted as being inclusive, i.e., the inclusion of at least one, but also including more than one, of a number or list of elements, and, optionally, additional unlisted items. Only terms clearly indicated to the contrary, such as "only one of" or "exactly one of," or, when used in the claims, "consisting of," will refer to the inclusion of exactly one element of a number or list of elements. In general, the term "or" as used herein shall only be interpreted as indicating exclusive alternatives (i.e. "one or the other but not both") when preceded by terms of exclusivity, such as "either," "one of," "only one of," or "exactly one of." "Consisting essentially of," when used in the claims, shall have its ordinary meaning as used in the field of patent law.

As used herein in the specification and in the claims, the phrase "at least one," in reference to a list of one or more elements, should be understood to mean at least one element selected from any one or more of the elements in the list of elements, but not necessarily including at least one of each and every element specifically listed within the list of elements and not excluding any combinations of elements in the list of elements. This definition also allows that elements may optionally be present other than the elements specifically identified within the list of elements to which the phrase "at least one" refers, whether related or unrelated to those elements specifically identified. Thus, as a non-limiting example, "at least one of A and B" (or, equivalently, "at least one of A or B," or, equivalently "at least one of A and/or B") can refer, in some embodiments, to at least one, optionally including more than one, A, with no B present (and optionally including elements other than B); in another embodiment, to at least one, optionally including more than one, B, with no A present (and optionally including elements other than A); in yet another embodiment, to at least one, optionally including more than one, A, and at least one, optionally including more than one, B (and optionally including other elements); etc. Each possibility represents a separate embodiment of the present invention.

It should be understood that, unless clearly indicated to the contrary, the disclosure of numerical values and ranges of numerical values in the specification includes both i) the exact value(s) or range specified, and ii) values that are "about" the value(s) or ranges specified (e.g., values or ranges falling within a reasonable range (e.g., about 10% similar)) as would be understood by a person of ordinary skill in the art.

It should also be understood that, unless clearly indicated to the contrary, in any methods disclosed herein that include more than one step or act, the order of the steps or acts of the method is not necessarily limited to the order in which the steps or acts of the method are disclosed.

In the claims, as well as in the specification above, all transitional phrases such as "comprising," "including," "carrying," "having," "containing," "involving," "holding," "composed of," and the like are to be understood to be open-ended, i.e., to mean including but not limited to. Only the transitional phrases "consisting of" and "consisting essentially of" shall be closed or semi-closed transitional phrases, respectively, as set forth in the United States Patent Office Manual of Patent Examining Procedures, Section 2111.03.

EXAMPLES

Example 1: Identification of Bacterial Strains Reducing Volatile Sulfur Compound (VSC) Abundance To identify bacterial strains capable of reducing volatile sulfur compound (VSC) levels, a high-throughput quantitative screen of isolated bacterial strains was conducted to evaluate reduction of known VSCs (e.g., hydrogen sulfide, methyl mercaptan, and dimethyl sulfide). Of 8 distinct bacterial strains of *Pediococcus pentosaceus* tested, 7 *P. pentosaceus* strains markedly reduced VSC levels (FIG. 1, rightmost group), particularly lower than control strain (Species 1, 2, 3, left groups). These results indicate *P. pentosaceus* strains readily reduce the abundance of VSCs including hydrogen sulfide, methyl mercaptan, and dimethyl sulfide.

11 distinct strains of *Lactococcus lactis* were tested, alone (FIG. 2A, 11 leftmost groups) and in individual combination with *P. pentosaceus* (FIG. 2B, 11 leftmost groups). While only one strain reduced VSC levels independently (FIG. 2A, second from left), all 11 strains tested further reduced VSC levels when combined with *P. pentosaceus* (FIG. 2B, 11 leftmost groups) compared to *P. pentosaceus* alone (FIG. 2B, rightmost group). These results indicate synergy between *L. lactis* and *P. pentosaceus* in VSC level reduction.

Next, VSC reduction was evaluated by *P. pentosaceus* alone or in combination with other reagents, including green tea polyphenol. As shown in FIG. 3, the presence of 4 μM green tea polyphenol (GTP) further improved the ability of *P. pentosaceus* to reduce VSC levels.

SEQUENCE LISTING (55 sequences)

SEQ ID NO: 1 - DNA, 1572 bp, unidentified
  source 1..1572: mol_type = genomic DNA; note = Pediococcus pentosaceus 1
atgagagtttgatcttggctcaggatgaacgctggcggcgtgcctaatacatgcaagtcgaacgaacttccgttaattgattatgacgtacttgtactgattgagattttaacacgaagtgagtggcgaacgggtgagtaacacgtgggtaacctgcccagaagtaggggataacacctggaaacagatgctaataccgtataacagagaaaaccgcatggttttcttttaaaagatggctctgctatcacttctggatggacccgcggcgtattagctagttggtgaggtaaaggctcaccaaggcagtgatacgtagccgacctgagagggtaatcggccacattgggactgagacacggcccagactcctacgggaggcagcagtagggaatcttccacaatggacgcaagtctgatggagcaacgccgcgtgagtgaagaagggtttcggctcgtaaagctctgttgttaaagaagaacgtgggtaagagtaactgtttacccagtgacggtatttaaccagaaagccacggctaactacgtgccagcagccgcggtaatacgtaggtggcaagcgttatccggatttattgggcgtaaagcgagcgcaggcggtcttttaagtctaatgtgaaagccttcggctcaaccgaagaagtgcattggaaactgggagacttgagtgcagaagaggacagtggaactccatgtgtagcggtgaaatgcgtagatatatggaagaacaccagtggcgaaggcggctgtctggtctgcaactgacgctgaggctcgaaagcatgggtagcgaacaggattagataccctggtagtccatgccgtaaacgatgattactaagtgttggagggtttccgcccttcagtgctgcagctaacgcattaagtaatccgcctggggagtacgaccgcaaggttgaaactcaaaagaattgacgggggcccgcacaagcggtggagcatgtggtttaattcgaagctacgcgaagaaccttaccaggtcttgacatcttctgacagtctaagagattagaggttcccttcggggacagaatgacaggtggtgcatggttgtcgtcagctcgtgtcgtgagatgttgggttaagtcccgcaacgagcgcaacccttattactagttgccagcattaagttgggcactctagtgagactgccggtgacaaaccggaggaaggtggggacgacgtcaaatcatcatgccccttatgacctgggctacacacgtgctacaatggatggtacaacgagtcgcgagaccgcgaggttaagctaatctcttaaaaccattctcagttcggactgtaggctgcaactcgcctacacgaagtcggaatcgctagtaatcgcggatcagcatgccgcggtgaatacgttcccgggccttgtacacaccgcccgtcacaccatgagagtttgtaacacccaaagccggtggggtaaccttttaggagctagccgtctaaggtgggacagatgattagggtgaagtcgtaacaaggtagccgtaggagaacctgcggctggatcacctcctt

SEQ ID NO: 2 - DNA, 1563 bp, unidentified
  source 1..1563: mol_type = genomic DNA; note = Lactiplantibacillus plantarum 1
tttgagagtttgatcctggctcaggacgaacgctggcggcgtgcctaatacatgcaagtcgaacgaactctggtattgattggtgcttgcatcatgatttacatttgagtgagtggcgaactggtgagtaacacgtgggaaacctgcccagaagcgggggataacacctggaaacagatgctaataccgcataacaacttggaccgcatggtccgagtttgaaagatggcttcggctatcacttttggatggtcccgcggcgtattagctagatggtggggtaacggctcaccatggcaatgatacgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttaaagaagaacatatctgagagtaactgttcaggtattgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagtatgggtagcaaacaggattagataccctggtagtccataccgtaaacgatgaatgctaagtgttggagggtttccgcccttcagtgctgcagctaacgcattaagcattccgcctggggagtacggccgcaaggctgaaactcaaaggaattgacgggggcccgcacaagcggtggagcatgtggtttaattcgaagctacgcgaagaaccttaccaggtcttgacatactatgcaaatctaagagattagacgttcccttcggggacatggatacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggatgacgtcaaatcatcatgccccttatgacctgggctacacacgtgctacaatggatggtacaacgagttgcgaactcgcgagagtaagctaatctcttaaagccattctcagttcggattgtaggctgcaactcgcctacatgaagtcggaatcgctagtaatcgcggatcagcatgccgcggtgaatacgttcccgggccttgtacacaccgcccgtcacaccatgagagtttgtaacacccaaagtcggtggggtaaccttttaggaaccagccgcctaaggtgggacagatgattagggtgaagtcgtaacaaggtagccgtaggagaacctgcggctggatcacctcctt

SEQ ID NO: 3 - DNA, 1563 bp, unidentified
  source 1..1563: mol_type = genomic DNA; note = Lactiplantibacillus plantarum 2
tttgagagtttgatcctggctcaggacgaacgctggcggcgtgcctaatacatgcaagtcgaacgaactctggtattgattggtgcttgcatcatgatttacatttgagtgagtggcgaactggtgagtaacacgtgggaaacctgcccagaagcgggggataacacctggaaacagatgctaataccgcataacaacttggaccgcatggtccgagtttgaaagatggcttcggctatcacttttggatggtcccgcggcgtattagctagatggtgaggtaacggctcaccatggcaatgatacgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttaaagaagaacatatctgagagtaactgttcaggtattgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagtatgggtagcaaacaggattagataccctggtagtccataccgtaaacgatgaatgctaagtgttggagggtttccgcccttcagtgctgcagctaacgcattaagcattccgcctggggagtacggccgcaaggctgaaactcaaaggaattgacgggggcccgcacaagcggtggagcatgtggtttaattcgaagctacgcgaagaaccttaccaggtcttgacatactatgcaaatctaagagattagacgttcccttcggggacatggatacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggatgacgtcaaatcatcatgccccttatgacctgggctacacacgtgctacaatggatggtacaacgagttgcgaactcgcgagagtaagctaatctcttaaagccattctcagttcggattgtaggctgcaactcgcctacatgaagtcggaatcgctagtaatcgcggatcagcatgccgcggtgaatacgttcccgggccttgtacacaccgcccgtcacaccatgagagtttgtaacacccaaagtcggtggggtaaccttttaggaaccagccgcctaaggtgggacagatgattagggtgaagtcgtaacaaggtagccgtaggagaacctgcggctggatcacctcctt

SEQ ID NO: 4 - DNA, 1559 bp, unidentified
  source 1..1559: mol_type = genomic DNA; note = Latilactobacillus curvatus
aagtttgattatagctcaggacgaacgctggcggcgtgcctaatacatgcaagtcgaacgcactctcgttagattgaagaagcttgcttctgattgataacatttgagtgagtggcggacgggtgagtaacacgtgggtaacctgccctaaagtgggggataacatttcggaaacagatgctaataccgcataaaacctaacaccgcatggtgcaaggttgaaagatggtttcggctatcactttaggatggacccgcggtgcattagttagttggtgaggtaaaggctcaccaagaccgtgatgcatagccgacctgagagggtaatcggccacactgggactgagacacggcccagactcctacgggaggcagcagtagggaatcttccacaatggacgaaagtctgatggagcaacgccgcgtgagtgaagaaggttttcggatcgtaaaactctgttgttggagaagaacgtatttgatagtaactgatcaggtagtgacggtatccaaccagaaagccacggctaactacgtgccagcagccgcggtaatacgtaggtggcaagcgttgtccggatttattgggcgtaaagcgagcgcaggcggtttcttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggatgtctggtctgtaactgacgctgaggctcgaaagcatgggtagcaaacaggattagataccctggtagtccatgccgtaaacgatgagtgctaggtgttggagggtttccgcccttcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattactagttgccagcatttagttgggcactctagtgagactgccggtgacaaaccggaggaaggtggggacgacgtcaaatcatcatgccccttatgacctgggctacacacgtgctacaatggatggtacaacgagtcgcgagaccgcgaggtttagctaatctcttaaaaccattctcagttcggattgtaggctgcaactcgcctacatgaagccggaatcgctagtaatcgcggatcagcatgccgcggtgaatacgttcccgggccttgtacacaccgcccgtcacaccatgagagtttgtaacacccaaagccggtgaggtaaccttcgggagccagccgtctaaggtgggacagatgattagggtgaagtcgtaacaaggtagccgtagagaacctgcggctggatcacctct

SEQ ID NO: 5 - DNA, 1502 bp, unidentified
  source 1..1502: mol_type = genomic DNA; note = Limosilactobacillus fermentum
cggcggtgtgcctaatacatgcaagtcgaacgcgttggcccaattgattgatggtgcttgcacctgattgattttggtcgccaacgagtggcggacgggtgagtaacacgtaggtaacctgcccagaagcgggggacaacatttggaaacagatgctaataccgcataacaacgttgttcgcatgaacaacgcttaaaagatggcttctcgctatcacttctggatggacctgcggtgcattagcttgttggtggggtaacggcctaccaaggcgatgatgcatagccgagttgagagactgatcggccacaatgggactgagacacggcccatactcctacgggaggcagcagtagggaatcttccacaatgggcgcaagcctgatggagcaacaccgcgtgagtgaagaagggtttcggctcgtaaagctctgttgttaaagaagaacacgtatgagagtaactgttcatacgttgacggtatttaaccagaaagtcacggctaactacgtgccagcagccgcggtaatacgtaggtggcaagcgttatccggatttattgggcgtaaagagagtgcaggcggttttctaagtctgatgtgaaagccttcggcttaaccggagaagtgcatcggaaactggataacttgagtgcagaagagggtagtggaactccatgtgtagcggtggaatgcgtagatatatggaagaacaccagtggcgaaggcggctacctggtctgcaactgacgctgagactcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgccaaccctagagatagggcgtttccttcgggaacgcaatgacaggtggtgcatggtcgtcgtcagctcgtgtcgtgagatgttgggttaagtcccgcaacgagcgcaacccttgttactagttgccagcattaagttgggcactctagtgagactgccggtgacaaaccggaggaaggtggggacgacgtcagatcatcatgccccttatgacctgggctacacacgtgctacaatggacggtacaacgagtcgcgaactcgcgagggcaagcaaatctcttaaaaccgttctcagttcggactgcaggctgcaactcgcctgcacgaagtcggaatcgctagtaatcgcggatcagcatgccgcggtgaatacgttcccgggccttgtacacaccgcccgtcacaccatgagagtttgtaacacccaaagtcggtggggtaaccttttaggagccagccgcctaaggtgggacagatgattagggtgaagtcgtaacaag

SEQ ID NO: 6 - DNA, 1453 bp, Leuconostoc mesenteroides
  source 1..1453: mol_type = genomic DNA
ctggcggcgtgcctaatacatgcaagtcgaacgcatagcgaaaggtgcttgcacctttcaagtgagtggcgaacgggtgagtaacacgtggacaacctgcctcaaggctggggataacatttggaaacagatgctaataccgaataaaacttagtgtcgcatgacacaaagttaaaaggcgcttcggcgtcacctagagatggatccgcggtgcattagttagttggtggggtaaaggcctaccaagacaatgatgcatagccgagttgagagactgatcggccacattgggactgagacacggcccaaactcctacgggaggctgcagtagggaatcttccacaatgggcgaaagcctgatggagcaacgccgcgtgtgtgatgaaggctttcgggtcgtaaagcactgttgtatgggaagaacagctagaataggaaatgattttagtttgacggtaccataccagaaagggacggctaaatacgtgccagcagccgcggtaatacgtatgtcccgagcgttatccggatttattgggcgtaaagcgagcgcagacggtttattaagtctgatgtgaaagcccggagctcaactccggaatggcattggaaactggttaacttgagtgcagtagaggtaagtggaactccatgtgtagcggtggaatgcgtagatatatggaagaacaccagtggcgaaggcggcttactggactgcaactgacgttgaggctcgaaagtgtgggtagcaaacaggattagataccctggtagtccacaccgtaaacgatgaacactaggtgttaggaggtttccgcctcttagtgccgaagctaacgcattaagtgttccgcctggggagtacgaccgcaaggttgaaactcaaaggaattgacggggacccgcacaagcggtggagcatgtggtttaattcgaagcaacgcgaagaaccttaccaggtcttgacatcctttgaagcttttagagatagaagtgttctcttcggagacaaagtgacaggtggtgcatggtcgtcgtcagctcgtgtcgtgagatgttgggttaagtcccgcaacgagcgcaacccttattgttagttgccagcattcagatgggcactctagcgagactgccggtgataaaccggaggaaggcggggacgacgtcagatcatcatgccccttatgacctgggctacacacgtgctacaatggcgtatacaacgagttgccaacccgcgagggtgagctaatctcttaaagtacgtctcagttcggattgtagtctgcaactcgactacatgaagtcggaatcgctagtaatcgcggatcagcacgccgcggtgaatacgttcccgggtcttgtacacaccgcccgtcacaccatgggagtttgtaatgcccaaagccggtggcctaaccttttaggaaggagccgtctaaggcaggacag

SEQ ID NO: 7 - DNA, 1478 bp, Lactobacillus acidophilus
  source 1..1478: mol_type = genomic DNA
tcctggctcaggacgaacgctggcggcgtgcctaatacatgcaagtcgagcgagctgaaccaacagattcacttcggtgatgacgttgggaacgcgagcggcggatgggtgagtaacacgtggggaacctgccccatagtctgggataccacttggaaacaggtgctaataccggataagaaagcagatcgcatgatcagcttataaaaggcggcgtaagctgtcgctatgggatggccccgcggtgcattagctagttggtagggtaacggcctaccaaggcaatgatgcatagccgagttgagagactgatcggccacattgggactgagacacggcccaaactcctacgggaggcagcagtagggaatcttccacaatggacgaaagtctgatggagcaacgccgcgtgagtgaagaaggttttcggatcgtaaagctctgttgttggtgaagaaggatagaggtagtaactggcctttatttgacggtaatcaaccagaaagtcacggctaactacgtgccagcagccgcggtaatacgtaggtggcaagcgttgtccggatttattgggcgtaaagcgagcgcaggcggaagaataagtctgatgtgaaagccctcggcttaaccgaggaactgcatcggaaactgtttttcttgagtgcagaagaggagagtggaactccatgtgtagcggtggaatgcgtagatatatggaagaacaccagtggcgaaggcggctctctggtctgcaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctagtgcaatccgtagagatacggagttcccttcggggacactaagacaggtggtgcatggctgtcgtcagctcgtgtcgtgagatgttgggttaagtcccgcaacgagcgcaacccttgtcattagttgccagcattaagttgggcactctaatgagactgccggtgacaaaccggaggaaggtggggatgacgtcaagtcatcatgccccttatgacctgggctacacacgtgctacaatggacagtacaacgaggagcaagcctgcgaaggcaagcgaatctcttaaagctgttctcagttcggactgcagtctgcaactcgactgcacgaagctggaatcgctagtaatcgcggatcagcacgccgcggtgaatacgttcccgggccttgtacacaccgcccgtcacaccatgggagtctgcaatgcccaaagccggtggcctaaccttcgggaaggagccgtctaaggc

SEQ ID NO: 8 - DNA, 1551 bp, Enterococcus faecium
  source 1..1551: mol_type = genomic DNA
agagtttgatcctggctcaggacgaacgctggcggcgtgcctatacatgcaagtcgaacgcttctttttccaccggagcttgctccaccggaaaaagaggagtggcgaacgggtgagtaacacgtgggtaacctgcccatcagaaagggataacacttggaaacaggtgctaataccgtataacaaatcaaaaccgcatggttttgatttgaaaggcgctttcgggtgtcgctgatggatggacccgcggtgcattagctagttggtgaggtaacggctcaccaaggccacgatgcatagccgcacctgagagggtgatcggccacattgggactgagacacggcccaaactctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatcccttgacggtatctaaccagaaagccacggctaactacgtgccagcagccgcggtaatacgtaggtggcaagcgttgtccggatttattgggcgtaaagcgagcgcaggcggttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacacgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcattcagttgggcactctagcaagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgcaggctgcaactcgcctgcatgaagccggaatcgctagtaatcgcggatcagcacgccgcgtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatctgaaggtgcggctggatcacctccttt

SEQ ID NO: 9 - DNA, 1538 bp, Bacillus subtilis
  source 1..1538: mol_type = genomic DNA
tttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatgcttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctt

SEQ ID NO: 10 - DNA, 1434 bp, Bacillus pumilus
  source 1..1434: mol_type = genomic DNA
tgcagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaggtggggcagatga

SEQ ID NO: 11 - DNA, 1546 bp, Bacillus licheniformis
  source 1..1546: mol_type = genomic DNA
gagtttgatcctggctcaggacgaacgctggcggcgtgcctaatacatgcaagtcgagcggaccgacgggagcttgctcccttaggtcagcggcggacgggtgagtaacacgtgggtaacctgcctgtaagactgggataactccgggaaaccggggctaataccggatgcttgattgaaccgcatggttccaatcataaaaggtggctttcagctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccgttcgaatagggcggcaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggcttccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatgggcagaacaaagggcagcgaagccgcgaggctaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttcta

SEQ ID NO: 12 - DNA, 1550 bp, Bacillus amyloliquefaciens
  source 1..1550: mol_type = genomic DNA
ctatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatgcttgtttgaaccgcatggttcaaacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatgggcagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacctttttggagccagccgccgaaggtgggacagatgattggggtgaagtcgtaacaaggtagccgtatcggaaggtgcggctggatcacctccttt

SEQ ID NO: 13 - DNA, 1549 bp, unidentified
  source 1..1549: mol_type = genomic DNA; note = Weizmannia coagulans
tggagagtttgatcctggctcaggacgaacgctggcggcgtgcctaatacatgcaagtcgtgcggaccttttaaaagcttgcttttaaaaggttagcggcggacgggtgagtaacacgtgggcaacctgcctgtaagactgggataacgccgggaaaccggggctaataccrgatagttttttcctccgcatggaggaaaaaggaaaggcggcttcggctgccacttacagatgggcccgcggcgcattagctagttggcggggtaacrgcccaccaaggcaacgatgcgtagccgacctgagagggtgatcggccacattgggactgagacacggcccaaactcctacgggaggcagcagtagggaatcttccgcaatggacgaaagtctgacggagcaacgccgcgtgagtgaagaaggccttcgggtcgtaaaactctgttgccggggaagaacaagtgccgttcgaacagggcggcgccttgacggtacccggccagaaagccacggctaactacgtgccagcagccgcggtaatacgtaggtggcaagcgttgtccggaattattgggcgtaaagcgcgcgcaggcggcttcttaagtctgatgtgaaatcttgcggctcaaccgcaagcggtcattggaaactgggaggcttgagtgcagaagaggagagtggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacctccctggagacagggccttccccttcgggggacagagtgacaggtggtgcatggttgtcgtcagctcgtgtcgtgagatgttgggttaagtcccgcaacgagcgcaacccttgaccttagttgccagcattgagttgggcactctaaggtgactgccggtgacaaaccggaggaaggtggggatgacgtcaaatcatcatgccccttatgacctgggctacacacgtgctacaatggatggtacaaagggctgcgagaccgcgaggttaagccaatcccagaaaaccattcccagttcggattgcaggctgcaacccgcctgcatgaagccggaatcgctagtaatcgcggatcagcatgccgcggtgaatacgttcccgggccttgtacacaccgcccgtcacaccacgagagtttgtaacacccgaagtcggtgaggtaacctttacggagccagccgccgaaggtgggacagatgattggggtgaagtcgtaacaaggtagccgtatcggaaggtgcggytggatcacctcctt

SEQ ID NO: 14 - DNA, 1529 bp, Weissella cibaria
  source 1..1529: mol_type = genomic DNA
gatgaacgctggcggcgtgcctaatacatgcaagtcgaacgctttgtggttcaactgatttgaagagcttgctcagatatgacgatggacattgcaaagagtggcgaacgggtgagtaacacgtgggaaacctacctcttagcaggggataacatttggaaacagatgctaataccgtataacaatagcaaccgcatggttgctacttaaaagatggttctgctatcactaagagatggtcccgcggtgcattagttagttggtgaggtaatggctcaccaagacgatgatgcatagccgagttgagagactgatcggccacaatgggactgagacacggcccatactcctacgggaggcagcagtagggaatcttccacaatgggcgaaagcctgatggagcaacgccgcgtgtgtgatgaagggtttcggctcgtaaaacactgttgtaagagaagaatgacattgagagtaactgttcaatgtgtgacggtatcttaccagaaaggaacggctaaatacgtgccagcagccgcggtaatacgtatgttccaagcgttatccggatttattgggcgtaaagcgagcgcagacggttatttaagtctgaagtgaaagccctcagctcaactgaggaattgctttggaaactggatgacttgagtgcagtagaggaaagtggaactccatgtgtagcggtgaaatgcgtagatatatggaagaacaccagtggcgaaggcggctttctggactgtaactgacgttgaggctcgaaagtgtgggtagcaaacaggattagataccctggtagtccacaccgtaaacgatgagtgctaggtgtttgagggtttccgcccttaagtgccgcagctaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcccttgacaactccagagatggagcgttcccttcggggacaaggtgacaggtggtgcatggttgtcrtcagctcgtgtcgtgagatgttgggttaagtcccgcaacragcgcaacccttattactagttgccagcattyagttgggcactctagtgagactgccggtgacaaaccggaggaaggtggggatgacgtcaaatcatcatgccccttatgacctgggctacacacgtgctacaatggcgtatacaacgagttgccaacccgcgagggtgagctaatctcttaaagtacgtctcagttcggattgtaggctgcaactcgcctacatgaagtcggaatcgctagtaatcgcggatcagcacgccgcggtgaatacgttcccgggtcttgtacacaccgcccgtcacaccatgagagtttgtaacacccaaagccggtggggtaaccttcgggagccagccgtctaaggtgggacagatgattagggtgaagtcgtaacaaggtagccgtaggagaacc

SEQ ID NO: 15 - DNA, 1539 bp, Streptococcus thermophilus
  source 1..1539: mol_type = genomic DNA
atgggagagtttgatcctggctcaggacgaacgctggcggcgtgcctaatacatgcaagtagaacgctgaagagaggagcttgctcttcttggatgagttgcgaacgggtgagtaacgcgtaggtaacctgccttgtagcgggggataactattggaaacgatagctaataccgcataacaatggatgacacatgtcatttatttgaaaggggcaattgctccactacaagatggacctgcgttgtattagctagtaggtgaggtaatggctcacctaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagtcaagaacgggtgtgagagtggaaagttcacactgtgacggtagcttaccagaaagggacggctaactacgtgccagcagccgcggtaatacgtaggtcccgagcgttgtccggatttattgggcgtaaagcgagcgcaggcggtttgataagtctgaagttaaaggctgtggctcaaccatagttcgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttggatcctttccgggattcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagatagaaagttacttcggtacatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggttggtacaacgagttgcgagtcggtgacggcgagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggacagatgattggggtgaagtcgtaacaaggtagccgtatcggaaggtgcggctggatcac

SEQ ID NO: 16 - DNA, 1499 bp, Lactococcus lactis
  source 1..1499: mol_type = genomic DNA
gacgaacgctggcggcgtgcctaatacatgcaagttgagcgctgaaggttggtacttgtaccgactggatgagcagcgaacgggtgagtaacgcgtggggaatctgcctttgagcgggggacaacatttggaaacgaatgctaataccgcataaaaactttaaacacaagttttaagtttgaaagatgcaattgcatcactcaaagatgatcccgcgttgtattagctagttggtgaggtaaaggctcaccaaggcgatgatacatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttggtagagaagaacgttggtgagagtggaaagctcatcaagtgacggtaactacccagaaagggacggctaactacgtgccagcagccgcggtaatacgtaggtcccgagcgttgtccggatttattgggcgtaaagcgagcgcaggtggtttattaagtctggtgtaaaaggcagtggctcaaccattgtatgcattggaaactggtagacttgagtgcaggagaggagagtggaattccatgtgtagcggtgaaatgcgtagatatatggaggaacaccggtggcgaaagcggctctctggcctgtaactgacactgaggctcgaaagcgtggggagcaaacaggattagataccctggtagtccacgccgtaaacgatgagtgctagatgtagggagctataagttctctgtatcgcagctaacgcaataagcactccgcctggggagtacgaccgcaaggttgaaactcaaaggaattgacgggggcccgcacaagcggtggagcatgtggtttaattcgaagcaacgcgaagaaccttaccaggtcttgacatactcgtgctattcctagagataggaagttccttcgggacacgggatacaggtggtgcatggttgtcgtcagctcgtgtcgtgagatgttgggttaagtcccgcaacgagcgcaacccctattgttagttgccatcattaagttgggcactctaacgagactgccggtgataaaccggaggaaggtggggatgacgtcaaatcatcatgccccttatgacctgggctacacacgtgctacaatggatggtacaacgagtcgcgagacagtgatgtttagctaatctcttaaaaccattctcagttcggattgtaggctgcaactcgcctacatgaagtcggaatcgctagtaatcgcggatcagcacgccgcggtgaatacgttcccgggccttgtacacaccgcccgtcacaccacgggagttgggagtacccgaagtaggttgcctaaccgcaaggagggcgcttcctaaggtaagaccgatgactggggtgaagtcgtaacaaggtagccgtatcggaagg

SEQ ID NO: 17 - DNA, 1572 bp, unidentified; identical to SEQ ID NO: 1
  source 1..1572: mol_type = genomic DNA; note = Pediococcus pentosaceus 2

SEQ ID NO: 18 - DNA, 1700809 bp, unidentified
  source 1..1700809: mol_type = genomic DNA; note = Pediococcus pentosaceus 1
tcgcacaagtagaaaaaaacaattaaaacatcttattttagaataaggtgtttttttgtatataaaaataattaagatcctaaagtaagtttgagcttcacttagagaacttttaattaatttcagtttaatatcccgataaattaagtaaagttaaataagtaccatttatttaacaaataataacgttttagtttacaaatgtattgaatagaactagaatgaaccttgtagaaaacttactaaaaagaagtggaatgatgggattatatgactgaaaaaattaatgcatctgatgcaatgattaaagttttggaatcatggggagttcataacgtttatggtctaccagggggatcttttgattcgacaatgaatgctttgtacaatcggaagagcaccattaattatgttcaagttcgacatgaagaagttggggctctggcagcggtcggagaagctaaggtaactggtaaacttggagttacatttggttcagctggacctggtgcagttcatttacttaatggtttatatgatgctaagcatgatcatatgcctgtattagctttggttggacaagttcctacaacattaatgaacacggactatttccaagaattaaatgaaaatccaattttcaccgatgttgcagtttataatcgaaccgtaatgactgctgaacaaatgccacacgtcgtcgacgaagctatccgccaagcttacaaatatagtggggtagcggtagttacaattcctaaggatttaggttggcaacccattgaagataactatgtctcatcagctaatctttatcaagcaccaatcttacctgaaccagatgtaaagcaggttgacgaagcgcttgaaattttgagtaatgccaagcatccagtgatgtacatcgggcaaggtacaagaggagctggatcagatattattgcattgtctgaaaaattgcatattccgattgttacatcagccttggctaagggaattgtccccgacagttataaggctaacatgggatcggctggtcgagtagcaactaaaccaggggtagaagttttacaatcagcagatgctgtaatgttcgtgggctctgattttccatttcagccttactttgttgccccagatgctaaatatatccaaatagatattgatgcaagtaaatttggtagaagacatgttgtagatttggctatcttagctgactcccataaattcctcaaggtgatgctagaaaaagctgaaactactgctgaaagcaaatggtataaggcagcattagaaaacaaaaagaattgggaagaatggaagaattcgtttgtgggccagcaagatacacccttaaatgttgaaaatgtttttgcgaagattaatgctttagcaaccgatgatgctattttccaagttgatgttggtaatgtaacgatcgatggcatgcgtttccttaaagctgatcaagctcaacgatttacgacttcaggttggtatgccacaatgggttatgccttaccagcagccattggagcacaagctgaatatccagatcgccaagtttggtcaatttcaggcgatggtggatatgccatggtaatgcaagatgtcctaactcaagttaagtatcatatgcctatcatcaatgttatattaacaaatgaaagcttaggctttatcgaagctgaacaagatgatagcaagcaaccacattctggtgtagatttgattgatacagattacggtacttcagcccaagcactgggggcagaaggatttgaagttcggacctacgacgaactggaacaagcctttgaaaaagcgaaagatcgtaaaggccccgtggtaattgatgttaagattacaaacttaagaccacttcctgttgaacagctacttttggataaagaaactcaagatcctgaagcagtcgaacaatttgttaagaagtatcatgctgaatcattgattcctttcagaaaattattagaagaagcataatttaaatactaaaaaacgggcgaaaaagtcaaagattgatttttcgtccgtttttatttgtttaagaaattaattgatggttataaaaaatgaagccaaaccaattagagcaattaggactagcaaagtgaagttccgaggtaggtgtaatttaggaataaaccaactaaaaactgctaaaatgggataaattaaagctgtccaactctttaaaagaataaaagcaaaaatcgtaatgattaaagttaatgctaaggcaaatattgcaaacttaaaactagttttaataaaaatagcaaagagaattatgataatcatcaaggataacaataagcccattttcaagagaatcgaagttacaaacccatttcgaatgtagaaaaaggcaagtggtgctaacgttccgacactaagcgaaaaagtaagtaatcctacaccatttttttgttcaaatggtaggaaagtagtcagaaatggcacaaaactaagtaaccctaaaagtgcaacgtaagtgttttcgctgaacagtagaattataaaggtcaaaattggaataatcgccaagggcgccattaaacgtaaattagttttgttagttagacgatcgatagtaagaaaatttaccatgaaagttgctaggaaaaataatatttgaatggaaagatgcttactgaagatttctgagctaaaatggctactaagataccaaggtaccaccgagagtaacaaagcattaatggcgggaagataactctttttttcaataggataattaaattttggtagattgattttattcatataaaactccttatgtttcctgacattaatcgtatacaaaagccgcaggaacgtcaacctaactttaaaagaaagagtgggtgtgatagacttagtaagttactagtgttcccgataggattagttatccaaaagatccttgtaaccgaaattaaatttagggggaatttacatgtcagaaagacatttatttacttcagaatcagtatctgaaggacatccagacaagatagccgatcaaatcagtgactctatcttagatgaactattaaagaacgatccagatgcacgagttgcttgtgaaacaaccgttacgactggattagtagtcgttgtgggagaaatctcaacaacagcttacatcgatatccaaaaggtggttagaaagaccattaaggatattggctatgtaggtggagaatatggatttgatggcgaaaattgtgctgtaattgttgctattgatgaacaatctccagatattgctcaaggagttgatgattccttggaaacgcgtgaaggccatgaagatcgattaaaccaaatcggtgccggagatcaaggtttaatgttcggatacgcaactaatgaaacagaagaattaatgccattaccaattatgttaagtcatcatttgatgcaaagaattgctaaactacgtaaggaacaagttatcagctaccttcgtccagatgctaaggctgaagtgacggttgaatatgatgataatgatcatccagttcgcgtagatacggttgttttaagtactcaacatgatcctgacgtaactttagaacagattcgccaagatgttattgaacaagttatcaaagctgtaatcccagctactcttttagatgaaaacactaatttctacatcaaccctacaggtcgctttgttattggtggaccacaaggggatgccggtttaacagggcgtaagattatcgtggatacctacggtggggccgctcgtcatggtggtggagctttctctggaaaagatgcgactaaggtggaccgttcagcaagttatgccgctcgttacattgccaaaaacattgtagcagctaagttagctgaaagggttgaagttcagattgcttatgcaattggggtcgcagaacctgtttcggtcatggtggatacttttggtaccggtacggtttcagaagaaaaattaacacaagccgttcgtaagatttttgatttacgacctgctggaattattgaaatgttagatttgaaacgtccaatttacaagcagacggctgcttatggtcatttcggacggactgacgttgaactaccatgggaaaagacggataaggttgaagctttaaacgacttttttaaaaactaaaaaatttgattaatggctgtgttgatgtctaaacggatattaacacggctattatattggttgagaggtaataaatggagaaaaaacaaacaaatgtggtcgttgtaacagtcgctatttttgttgcaacttttatgtcggcgattgaaggaacaattgtttcgacagcgatgccgaccattgtaggagatttacatggcgttagtttgatgaattgggttatttcaattttcctactaactaatgcaatatttaccccaatttacgggaagttgtctgatattttcggtcgtaaacgagtgttcatttttggaattattatatttttgattggctcgatgttaagtgggatggcccactcaatgggtttcttgattttatggcgcgcattgcaaggaatcggggctggatcgattatgccggtttctaataccattattgctgatatttatccgattgaaaaacgggccaaggtaatgggactaaatggttcagcatggggaattgcttctattattgctccgctattagggggctttattgttgataatctgagttggcattggattttctttatcaatttaccgattggaattatcaccatctttttaattcagttcttccttaaagaagaggttagtgtccatagcaagaaaattgactacctaggtagtttttggttaatggtagctttactgggactaatgtacggttttcaattgatgggtgaaagttcattctcatggattacattggtgatttcgtttgtgattttcatcgtgggagctggcttatttattcgtcaagaaaaacgggcggaagatcccattattttcctagatttgtttaacaaccgcacatttgtaattcaaaatgtggcgacgatgttggtctctggtttgttgattggtttcgaagtttacttaccaagctggacgcaaggaattttaggagtgccggcttcattagctggatttgcagtaactccaagttcaattttatggattttcggttcattcttggcaggacggatgattgttaagttaaaagccaaccagattttgaccattagtttatcaattctagctgttggtagcttactattagctttagtaccggcttcaacgccgttcttagcgttcttctttattgcagctattttaggagttggttttgggattacaattacttccacattagtaatttcacagcaattagtaactaaagatcggattggggtagcaacttcctttaatactttggctaagacactgggccaaaccattatgatgtccgttttcggaatcattatgaatgggacgatgaatgccggagttaaggcgaaccctaaaattaatatggatatgatgaacaaagttatcaatcctcaaacggctaaaactttaccagaaacgttattgccaacgttgagaaatgttttatatcaagctttgcataatatctacattggttgctttattttgattgtggttgctttaatcactaatgcgtttgaccgtcgctccaaagataatatttaaaaaatgtatttagaaggctagctgagaggctagccttctaaatacattattttttacgctcaatacacaataaaatgggcggattattaatctgattgatgaattcatagcgtaaacacgaatagtgatgttggtcgagttcagctacaaatgaaagtaattgttgcaattcttcttgacctccaggatgaccgtagtaacaaactaggataatacgaccaccaatttttaactgatttaaactttgttggactgccgagatagtggaagtgggatgagtaataattgatttatctccacccggtaaatatcctagattaaagatggccccagtaatgggttcggtgacataatggtcaatttgatcatgactagcatggattagttcaacattagttaagggttgatgctggtgctcaaatagggctcgagtttgctctaaagctgctttttgaacatcaaaactaaaaactcggccagtgctttgaaccaattcacttaaaaataaagtgtcatgaccatttcccatagtggcatcgattaccacatcgccgggttgaacaatttcagttagtaattgatgactgtattgcatggcattatcaagcatttttaattttccttccataaaagagataggttgtaaattgaagaacgattaaaccaagtaagaatcccgccgtaacatccgttggaaaatgaacgtttaaataaattcgggataggccaatgcctagcattagaattaagtagattaatgctagtaagtttcgttttaattgatgatggacaacttggaaagtgataaaaattaggcttccaaataaaaccatagccgccactgaatgaccactaggaaaactataaccaccaatactgattaaacggaattcggggcgttggcgttgaatgatttgtttaattaaatgattaagtccatttccgaggacaatattacaagccaagaataaagcggctttctttaggtgctttagaattaaaattaagcagactatcaagctgataattatgtaaggaatagaattacctagctgggtatagatgctgaccacttgattgaatccaggcgttcggacagattgcaccagactactgatgctgttgtcataggcgtgtacccagctgggcttaaaaataactaaacttacgattaagataaataaaagcgtaggtagaatattgattaataaatgagtatattttctgctgtgcatacgtttctcctttaacttcataattaattttagcatattgagttgtaatgaagcgtggagattggtatgataaacctaactaaatattgtcgataaaagaagtagtagttgggatggacattttaagagaccgaatggctagtggaaattcggaatgactttcaacgaactcgtctttaaaattaacaatcttgaacctaagtagagattgtcgttttccgcgttaaggtattcaagtgtgcattttgcaaaacataggtggtaccgcggaacttttcgtcctaaggattcttttttagaatccttaggttttttttatcgacaaatataataatggaggaaactatggcttataatcataaagatatcgaacagaagtggcagcaattctggagcgacaatgagacttttaagacggtcgaagatgtagacaaacccaaatattatgcattagatatgttcccttatccatcaggtcaaggactccatgtgggtcatcctgaaggatatacagcaacagatattatgtcacgaatgaaacggatgcaaggttacaaagtacttcatccaatgggatgggatgcttttggtcttccagcagaacaatatgcgatgaagacaggtaacaatccgcgtgattttacagctaagaatattcaaaactttaagcgtcaaatccaatcacttggtttttcttatgactggtcgcgagaagttaatacaactgatccagcttactacaagtggactcaatggatttttgagcaactctacaagaagggcttagcttatgaaaaagaaacgctagtaaactgggctcctgatttaatgggtggaacggtagttgctaacgaagaagttgtggatggtaagacagaacgtggtgggttccccgtttatcgtaaaccaatgaaacaatggattcttaaaattacagcttacgccgaccgtttgattgacgatttggacctggtagattggcccgatagtattaaagaaatgcaaaaaaactggattggtcgttcagtgggggctagcgtcttctttaatgttgaagatagcgaaaaacaaattgaagtatttacaacgcgtccagatacattatttggcgcaacatacttggtaatttcaccagaacatgacctcgttgaccaaattacaactccagaaagtaaagctgccgttgaagaatacaagaaagctgttgcaactaaatcagatcttgaacggacggatttgaataaagacaagacgggagtcttcacgggagcatacgcggttaaccctgttaatggtaagaaaattccagtttggattagtgattacgtattggcttcatacggaactggagcagtgatggctgttcctgctcatgatggccgtgactacgaatttgctaagaaattcaagatagatatggtaccagtttatgaaggtggcaatcttgaagatggagtattggacagcgaaggcgggctaattaactctggattcctagatgggatggataagcagacggctattgataccatgattagctggttggaagaacatggagttggtcataagaaggttaactatcgtcttcgtgactgggtcttctctcgtcaacgctactggggtgaaccaatccctgtaattcattgggaagatggagaaacaaccttgattccagaagatgaattgccattgagactcccagctgcaactgacattcgtccttccggtaccggagaaagcccattagctaacttagatgattgggtaaacgtagttgatgaaaatggacgtaagggtcgccgggaaactaatacaatgccacaatgggcgggtagttcatggtacttcctccgttacgttgatcctaagaatgatcaaaagattgctgacgaagatttacttaaagaatggttaccagtcgacttatatgttggtggagctgaacatgcggtacttcatttactttatgcacgtttctggcacaaagttttatatgatctaggagttgtaccaactaaggaaccattccaaaaattggtcaaccaagggatgattctcggtagcaatcatgagaagatgtctaagtcaaaagggaacgtagttaatccagatgatattgttgagcgctttggagcggatactttacgattatacgaaatgttcatgggacctctgacagaatcagtcgcctggagtgaagatgggcttaacggaagtcgtaagtggattgaccgcgtctggcgcttgatgattgacgacgaaaaccaattgcgtgatcatattgttactgaaaatgatggcagtttggatatgatttataaccaaactgttaagaaggtaactgatgattatgaaaacatgcgctttaacacggctatttcacaaatgatggtctttgttaatgaagcatacaaggctgataaacttccagcagtatatatggaaggattagttaagatgttagctccaattattccgcacgttgctgaagaactttggagtttgctaggtcacgaaggtggtatttcatacgctgaatggccaacatatgatgaaagtaagttattagaagctacagttcaagtcattctacaagttaatggtaaagttcggagtaagattaccgttgacaaggatatcgccaaagaagaacttgaaaaattagcgttagctgatgctaaaattcaacaatggacggcagataagactgttcgtaaggtaattgttattcctaacaagatcgttaatatcgtagtaggctaactaaatcaaaagtagggtccagatgttttaacagcatcgtggacccttttttgtagaaaaatagtttggaaaatgaactaattttgagagtttggtggattttttaagtgttagctgagctatcagcgtaaatttaattgtatcggaggtatgaattgtattaaaatagtgtagattgactagagaaagtaggtttttataaatggataagcaatctgaaatggataattcagagtctctctatatgggttcacaacccttaagagataattcaggaaaatcttcatccaaagcaaagatgctcgaaggttcggcgtggatgaccgccggaagtatcttttctagaatattaggcgccatttatattatcccatgggtaatttggtttggtgtttatagtgaccaagcgaacgctctttttactaaaggatataatatttatagtttctttctaattgctgcgattgcagggattccatctgcgatttccaagcaggtatcccattacaacgcaattaatgagtttgcgttggggcaacgtttgtataagcgggggcttttgttatccgttggaacgggaattatctgtgccgcaattctgtattttggcgctccatttttaaaagatggtgacccgaacgtaattacggttctccatgcgttggcttgggcagtgttagtaattcctacgatgagtttgactcggggctttttccaaggttaccaagaaatgggaccatcagccgtttctcaatttattgagcaattagcccgagtgatttatatgctaacaaccgcctattttattatgggaaaaagcggtcaaggcgattgggtttatggcgtttcacaatcaacctttgcggcttttattggtgcattaggtggattattagtgcttgggatttatttcattaaataccgtaagcgactttcctatttgtcacaacatagtgccaatgaactggtagtttcaacgtcaacgctatataaagaaattattgctcaagctgtaccttttattattattggatcagctattacaattttccaattaatcgaccaatacacctttttccggattatgaatgcggtgagtgactattcgactgccgtcttaaataatatgtacgcaatctttgcttttaatgctaataaactggtaatgattgttatttcattagcgtcagcgatggccgtcacttccgtaccgattttatcggaagccaaaactaggggcgatcgagcagaaattagtcgacaagtaacggattcaattttgctctttgcatttttgatgattccagctgctttagggatggctgcggtagctcaaccagcatacacgctgttctatcatctaagtgatgtaggaactgccattttacaatttaattcttatgtagcaattgttttaggattatttacagtgatttcggctattatgcaaggaattggtgaaaatgtcttagccgtgaagtatttctgtgtcggaatgattgttaaatttattttccaatttcccatggtggcattattttcagcagtgggttcattaatttcaacggctattggatttatggtagtgaattggttgattttacggcatatcaacttggaatatggcttagattatcgtcgaattaatacatttattggaaaaatcatcacttatgcttttggaacattcttgattgcaatggtcgtaactaatggattatacatagtgatggatccagccagtaaagtacaatcgttactagttatagctgcggccgtagttttaggtggagcattttatctctactttgtattaaagagccgcctagcggatgaaattgttggggcacgggcagctggcttacgtcgaatgctaaagattagttaggaggagacatgcgagtagataaatttttacatgacatgaatatgggaacgcgaacccaaattcgaaaaatgattaaagacaagctaatctttgttaacgatacggtcgttaaaactgggcgagttaaagtagatccagtgattgatgaggttagattaaaagaccaagtgattgagtatcaacaatatttctatttcgtgatgaacaaaccattgggagtcttaactgctacggaagatcgtaaacaaaaaaccgttatggatttattcaacaaggtcgatctccgaagtgatttatttccagtcggaagattggataaagatacccaaggcttgctgctaatcactaataacgggcagttagcgcatgatttattagcaccagagcggcacgttgataaaacttacgaggcggtggtaactggaaaaatcaccgatcaagctgtcgaagaatttcaaaaaggaatcaccttaaaggatggtactacgttaaaaccagcgcaactgatcattgaacactattcagaattagatgatcaaacagtggttaaggtagtcctaaaagaaggaaagtatcatcaggttcgccgaatgtttggtagcctaggtgagaaagtggtcactcttcgaaggacttcctttggtcctttagaattagatgtgggattacttcccggaacttatcgagaattaacggatgatgaaattaatcggttagttgaaggttaaaaataagctactatgatttttatcatagtagcttatttttttgaagttgttttagtgtgaaggggagacgacgaattaagcgatggggcaaaacaaccgcttctttttgataaatttgatcggcggtataactgtgtaagaaggttcctaaggtaacacctaaggccaaagagtcgacttggtttactaacgcaataattactccagttaaggcgtctcctgaaccacctgttgccatcccagggttaccagccataatttggcgaaagtcggtatgaggagcgtaaatttcagtttcataatgctttagaactacaattgcttttaaatgatcaactgcacgttgatttagcgtgggggcttgatctgctatctttattccggaaagtcgttgccattccatttggtgaggagtaaaaatagtttggggatgatctacttgaatttgatgggtagcaatcaaatcaatcgctgaaccatcaataactaaaggtgtttggggttgaacgtggtccaagaccaattttaaaatttttaagctagtagcattagttcccaatcccggaccgattaccactcccgttgatttttttagggctgcttttaaagcatcaaaatctaagaaatcgagcaacataacttcggctagggtggagcggacagccgtaaagttagatttatccgttgctaaggttactaatccacctccagcataaactgccgctgaacttgataaaattccagcgcctccatattgatcattaccagctacgattaaaatccgaccataacttcccttgtgactatcattggaacggacaggccataagtcgttcaatccgtcctgattaatctttaacattgtgatcacctcgtaaatgtagtataccgcaaactagtataaaacatgcaaaataaaaatcgaagaaaatgcataaaactctattatgtaagcgctaaattgttataatagaagttgaaaggttggtgtgtaatatggattataaaaaaattttatttggctatgatggttcaccagaatcaatggcagcttttgatcgagtaattgaggttgcgaagagaaacgatgcaaaacttattattgctcatgtagtaaaaaggcaacacgctaacactgagagtgtttcccttggctttggtgttgtatcaacagatgatgacattgaggacattcttcgttctagggaagataaacttgaagttttgaaacaaaaagctaacgaaaaaggcgttgaagatgtgaaaattgcccttaaaattggtagtcctaaatcaatgttaagccgtgaattgcctaaagaatacgatatcgatctaatcgttttaggtgcgaccggactaggcaaggtcgctcaagtatttatcggttcaacggctagttatgtagtcgaaaattcacctacagacgttatgattgttaaaaattaaatgataaacaaaatgacctcaattgtcggcactttagttttaaactagagtggaacgacaattgaggtcattttaaattagattgctttatgcataggttcttcaacccgaacttctttaagtttagcattgatttgtttaaggatgattttaacgttttcttcgttgcttaaatcgtacttttgtaaatcaattttcattttaggaccaacatcatattcttcgtaccatgtcttgtaagccgaccacatcttatagtagtaagattccaattcaggattgttatcgaattgttcgtattcacgcccacgtttacgaatacgatagaggatggtatcaaaatctgtttcagcatagaccatcaaatctggtgctttcttaggtagattttgaagctcactcatcatgttatcaagaaggttcatgtaaacttcaaattcagtatccgtaatgttaccttctttgttgttttcgcgtgtgaatagagcatcttcgtagattgagcggtctaatacattattatcatcagtcaaagcttttttgatcatttggaatcgtttattcaaaaaataaatttgaagtaagaatccataacttttttggtcagaataatagagtggtaaaacgggattgtctccaactggttcgtagaacgcctttgttccatagtagtcagcaattttccccgttaatgtagttttaccgacgccgatcattcctgctgtaattatcaccataaaatgctcccttttccattttttttgccgaaatctagtattaataaatcctaaatctttaaacagccacaacatattgtataaagaattgaagcgcaaaacaagcttgaattttatttaaaaaactgcttagtatttgaatacccaaaaatgaaatggtttacttaaaaaattaattattatttgaaaagcgctaccaaattcgataggctagagatatgttagattgtgaggaagaattttatgataaaactaatcgttagtgatttagatgaaactttagtaggaccagacggaaatgtttctgaagaaaacattgaagccattaaaaaagcaactcaaaagggggttaagtttgtccctaataccggacgaggatttgaatcggtacaacctttattagaaactctgggattgaagggaaaagcaaatgaatttgtgatttcatataatggtggagcaattgttgaaaatcaaaattttgatgtaatccaagctaatgcattttcgtttgagcaagctactcagatttttgatataaccaagcagcatttggagaattcgacgcatatttatacgttaaatgatgtttatgtatttaatgaagttgaagaagataatgaatatattcgtagtcgtggggttcgcaccattagatttgaacatgataatctggatacattaaaagatgaaccaatttttaaaataattacaatgaatcctgattttaataagagaaaacagattaaagcagaagtactagataaagttaatttcgatgtgaatgctactttttcttcagatcgatatactgaatttaatttaaaaggtgtcgataagggtcaagctacgctagaacttggacgccatctaggtataaaagcggatgaaataatggcattgggcgataataataatgatgtagcaatgcttaagagtgtgggacttcctgtggtagtttccaatgctagtgcatctgctaaagcaaatgctaaatatattgctaaaggaaattatgagacaggtgtggctgaggcaattaacaaatttgtattagggaaatagtagcatgcaaaaaaagacttattaccgaagttcgctgattttactgatcctatcaacgattattatgataatgacttgggtgtcatcattgagtaaaacgaataaatttattattataataattgttgggataattctgacatggtatattcaatatttctcaacgcgactgacagatgttaagaaaaatgggagaaagcaatgaagacattgaaaattgggattcccttgattgtggcggtaattttggtactcgtgacggaatttacgcacatgagcggggcaccattggtaattatgtgggtcattggatttttattttcaatgattgtaactgcggtgattgaaattcgaacacgaatgcaagaatttgctaagcaacaaaaagaggaagaaaagcagcagggggaagaataaatgtttatcacaaccgaaggtatcaatgccggttatacaattaaggacgtggttgaagcaaccggtagcttgatgttagcttccgaagacatcgataagtacaatatgtttgatcaactatttgatgaagcaaaacaaaagttgaaaaagaaagctgatttgcttgaaggcgacggaattatcggcttaaagtacaatacagaagtagtagaagtcaatggggcacccaagtttttggtagtccatggttatggtacagtaatcttaattgataaatagaaacgactaagaaacaggattgtaaatcctgtttcttttttcgatacttaattgatttttctgtaacatattaaaggacttattagccacaataatcgcttattgggtgtggcgtttaacttcgaggggaacgatatcacaaattttaacccgcacggtatagttaactttataagcggcataacggtcgctaggatcatagtctagaatgtctacaattgcatcattatcaatcacatcgctaatttttccaacgaaaggtttcgagaggtcgttggatttataacatttaacgatccgattagcttggaatgtgtttaccacgtcatctcaactccttgtgtctattatatcttatttattgatattatatcttatttgtggtcatttccagtgctaataatactgataaagagtaaaaatatgctcattttgcgacaaagaaaaaatatttgttcacttttaataaggggaggtgtaaaatgtgtttgttaagccacagtggcggaattggcagacgcgcagcgttcaggtcgctgtataggcaactatgtgcaagttcgaatcttgtctgtggcatataattttaacgtatataaattaaaggaaactagaaattaattgagaaatttaacttctagtttttttgtgttggtgaaacgattcacatcgttgaagatttaccctgagcaaaaaactggcgtaaaattagataaaaagtatactgatgctgtaattgattttttgaaaggaatagatgatgcgaaaactaaagtatactcaacaagatcagtgggaatcagaggctcgagaaacccaatcaccaattctaattgaaacggcaaagttaaaagctaagaaaaatcagattgtggatgggttgaaaaattatactgcaacagaattacataaaaattataatagtttatcgttaactgctaatgggaaaatggaagcagatcaacgaagcttccagctggaggaggttcatttccatcatccagcagaacattgctttaagggtgaggctacaccgcgagtactagaggcacacttcgtccattatggtcgcctcagacagcctttagtggtcagtgtgacctttaagttggggtctaaaaatgctacttttgaaaaaatattaacggctatggatgataataaagtggaacaattcatacttttagatgatttgattccaaaaaggggttatttttatcgctacataggttcattgactactcctccattaacggagggcgtagagtgggtggtatttgagcaagcccaaatgattgatattgatcaacttaatcactatatggcgacatttaaggaacaaaataatcgagaactgcaaaaattaaaccaccgaaaaattgaaaaatatgaaatttaagctaaaaagctggtgtcaacgaaagtaacagagacaatgactaaacaatcattgggaatactttcgatgacaccagcttttatattgcatggataattaaagaaattccaaaaatcaaaaataatagagcaatcatcatagaaatggagattgcagtaataaggggtgagaatagtaaaacaattcctaggataatacccaagattgagataaatacatctaaaacaaaatatttgtggctaaaatttctaatataattagccagccaaagggtggtgaaggaatcacctaaaaacattaaagcaatcaagactgaaacatagaccataccaaacgaatcattgaataacattagaaatccgacgatgatgtcaagtacggcatttagggtcaaccaagtagttttaccaagaaaaggtcggatccaaaataatttataaaatcccgtagataaggacgcaatggcggcgatgacaatcaccatcctaaaagttgataaaggatttttgattgaaaaaatagcaatcacaataaacaaaacacctaaaattagagcaaacggatcaaacttattaatacgattttccatctaaatcactactttcttgaagtttttattcagccaaaaaaggttggaaagagctaaattgtacatcgaattttaaaagtagtatcttaaaggctaaagtactactatccgacactaatctagttagcttcattttagagagattggttgaattgttcaaacaataagaattcgaaatcacgattaattgttgatgcaacgttttattttccagttaacatatttaagaataattaacggtagtagtattggtttctaatttttgctaaaatgttatctgttactggaattatagaacgatatgtatatatttgaaaaataaaaggggattacaaaatgtgcggatttgctggttacattaatcaagctaatgtaaataaagacacaatcaagtcaatggccgatcgaattaaacaccgaggaccagacgatgaagcatttttccaagatgaaaatgcgtcaatgggattccgtcgcctatcaattattgatttggcacacggacgtcaacccatgatgaatagtgctgaaactaaagtattaactttcaatggtgaaatttataactacaaacaagttcgtgaagaactaaaagaattaggatatgaatttagaacggatgttgattcagaagtcctaatccatggttatgacgcatggggaccagaattacttaaaaaacttcgtgggatgtttgcctttgtaatttatgataaagaaaaacaagaagtatttggtgctcgtgatcattttggaatcaagcctctttactactacgatgatgataaaacgttcctttggggttcagaaatcaaatcattcctagaacatccaaactttgtgaaggaattcaatgaagaactattaccaatccacttaagttttgaatttattccttctaaagaaacgatgtttaagaatgtttacaagcttcttccaggaacttacttcattcataaaaatggtaaaacagaaacccatacttactttaaatttaactacgaccatatcgacgaatcacaaactatcgaagaagattcaaagaaaattcgaaagattgttagtgactctgtagatgcacatatgattgcagacgttgaagttggtagtttcttatctagtggaattgattcaagttatgttttagcagaagctgctaaacttaaacctatccaatctttctcacttggatttagaaattctaagtatagtgaattaagttactcaactgaatttgctaaggaaatcaatcaaaagaatacaccactctacatggatggtgatgattactttgatattttgccaactatcatgtactacatggatgaaccactatcaaatccatcagcaatgcaattattctatctttccaaaggtactcgtaagaatgtcaaagtggctctttcaggagaaggtgccgatgaattctttggtggatacaatacttatctagaagctttcacatttgaacgttaccaaaagatggttcctagctttattcgaaaagggttggctaaggcagtttcaggtcttcctcgtttccatggacgtcgtttcttgatgcgtggggctcagccacttagtgaacgctattaccgcgtaaattacgtatttaatcaacaagaacgtgatcaaattttacgtaatccagctttgaatgttgattcaggagcttatacacaacatatctttgacgaagtgaagggaaaagatgagatgactcaaatgcaatactttgacatcaatacttggcttccatttgatatcttgcacaaagctgatcgaatgagtatggctaactcactagaagttcggacaccgttggttgaccgggaagtagccaaatttgctgcaaccatgccaattaagactcgaattcataaagaagaaactaaggtatctcttcgtcgtgctgcagaagctgaattaccagaacgagtagctaagaaggaaaaacttggtttcccatctccaatcgccaactggattaaagaagataagtatcgtaaacgaattgaagcagctttcaattcagacattgctaagaaattctttaagccagaagctttaatgcatattcttgaagaacatgttaacggaaaatcaagtatgcaaaagattttcacaatttacacatttattttatggtatggagttttcttcccagaagataccaatactaatacaatagatttagttaagagaactcaagtataggtggagatgaaatagatggaccttgaaattgccactgttaaggcaatccttacagaacatgatttattaaaagaaatcaaatcaactaaaacagttgcaaatactggaatatcttatgattctagaaccgtaaagccaggttatatgttcttttgcaaaggaaatttcaaaccagagtatttatcagtagcccgccaaaatggtgctaccacttatgtgtctgagaatgaatatccagaaggaaccggcatgactgcgattattgtaacgaatgttacaagagccatggcggttctttcggctacttattacaattttccgcaaaatgacttgtttattatcgggattacgggaacgaagggtaagaccagttcagcttactttgcacactcaattttgaatcaaaagtatccaaaccaagtggctctattttcaacaattgatcgaattgtgggacccaagcctgaggaccaatttaaatcagatttaaccacaccagaatcaatgaatttattccatgatatgcgagtcgctgtggataatgggatgaaatatctggtaatggaagtgtcttcgcaagcttatttaagagaccgggtttatggattaaaatttgattgtggaatctttttaaacattacgccggatcacattgggcgcaatgagcacaaagattttgaagattacttgcattgcaaattacaattaatggttaactctaaacgttgtattattgatgcagatacagatcgttttgatgatgtttttggcgctgcaaaagcaacaactgatccggaacaaatttatttgtttagtgcagatgttgaaaatggcggagtagatttcttaattcaagatgaagaagatgatcttacttccaatcgattcactttggttgaaagcagttcaaaagcagaagcattccacgtggcaggtgattacgatttaaatgtggcgggcgattacaatcaaagtaatgcaacggctgccattattgctgctgcccttgcagacgttacttatcaggatgcagtgttaccactaaaatcaatcgtgattccaggtcgtatggaacatctagatgttccaggacatggagtggtttttgtagattatgcacacaattatgctagtttgcacgcactattaaaattcttaaagcatcaatatcacgatggtaaggttatcgtggtggttggaagtcctggtgataaagggatttcgagaagagctgggttcggtcaagcgttgagtgaacaagcagatattgcttatttgacaacggatgatccagcttttgaagatccagaacaaattatccagcaaattatggataatattaaacctggtacagttgaagttcgtcaggtacttgaccgacacgatgcaatcgagcaagcgattatgaatagtagtgagaaagatgtggtcgtgcttgccggaaaaggtgaagatccataccaaaaagttggaggggtagatactccttggccaactgatatgggagtagcagaagaagtgaagaggggattaagttaatggaaagaccaactaacaattttacgccaattctattaggtagtgattttaatgcttatgggatggctcgttcattttacgaaattacaggaagacgtgttcaagcgtatgccgggaccgtgctagcacccacacgttttactaaaatcgtgaatgttgatattattcctggtttttcagaagaccctgtttttattgaatcaatgcgtaaaattgctaaaaaatacgaaaattctgacgagaaggttgttttactagggatgggcgatggctacgctgaattgatttcaaagcataaagaagagttgtcaaaaactttcatttgtccatacatcgattatgatttattgaaacaattgaataataaagaacgtttttattcaatttgtgatgaatataatttaccatatccagcaacccattttattacgaaggcacaatatgaaagtggtgagaaattcatctcaccttttgaatttccggttgctttgaagccagctgacagtgtagaatggctcgatattcattttgaaggtcgtaaaaaagctttcagaattaaaactcaagcagaacttgatgaagtcattggtaaaatctatgacaatggctatacttctgatttgattttacaagattttattccaggtgatgatagcaacatgcgagttttgaatgcttatgttgatcaaaatcatcaagtaaaaatgatgtgtttaggtcatccattattggaggatccagctccatcagcaattggaaactacgtagcaattattcctgaatttaaccaagaaatttatgacacggttaaaaactttcttgaaagtatcaattacgttggatatgccaactttgatatgaaatatgacagtcgggatggtaagtttaaattatttgaaatcaatattcgtcaaggccgtagtagcttctttgttacattaaatggatacaacctagctcgttgggtggttgaagaccgagttaacaatgcgttggctgatcgtgaaactgtatacgctaatgatgttccaggcaactggaagttatggttgggcgttccagttaaggtcttcaaaaagtatgctaaaaataatgatgataagcaaaaggcacttgaactaattaacaatgatcaatatggatttaccgctatctacgatgaggatatgaactttaagcgtagcttattaatgtggtggatgaaccataattatgttaagaactttaggaagtattttaaggaaaataaggggtaagacctgtgaaaaaattctttacgattattggtggaatggggactccagcaactgaaagttacattaggttattaaatgctagaactcctacccatcgcgatcaagattatttaaattacattttagtaaaccatgctacagttccggatcgttcaacctatttaatggaccattcgcaaccaaacccttacccagatttattagaggacattcaagaacaaagcaagctgaatccagccttttttgtaattgcctgtaatactgcacactttttctatgatgatttgcaaaaagcaacggatgtgcccattgtgcatatgccccgcgaaactgtaaaacatatcaaagagcagtatccaaatgctaaaaaaatcgggattattgggacacctggaacgactagtgatggaatttatgaccgtgaattgttagctgaaggttttgaagttgttaaaccaactaaagcaattcaggatttaactagcaagttaatttttgatgatatcaaagaacaaaatctagtcgatgctgagcttttctatcatattctaaaaatgatggtagaagaacaaggagccgatgtggtgattttaggttgtactgaattatcgtatgctcaggaaatggctcatgatcacagttttccggttgcagattcacaatcggtattagtagataaatcgatcgaaatggctttgaaactaagaaagtaaaaataaaagttgggattaaactaaaccagtttgtcccaactttttactatgattaacttggaggaagagatgagtaaacgaagaagaaaaaataagcagtctactagtatttggcttgttttagtaattgccattttaggaacttttttcaaaggaaatgatattcatcagtttgtttctaatctgattagtcaggggatcccacaaacgactaaatcggttaaaagtgtcgaggatactcaattatctcaacaaacttttaaatccggtggaacagcttatatttacgttaacaataataaaagtacccttaatcccgcagattggaagaaaaaccaaattatttacggtaatttagatcgtttgaatcggacgacacaagcaacgggatatctaagtcgtgtaaacttagttaagtcgaataccagaaccagtcagacttggaatccaactggttggcatcaaaaacgtttaaccattaacggtaaaacaactgaaattcagaaccgaggccatttactagcatattcaattactggtaaatttgatcaaaatgggaatttcaatgctcatgaattaggatcattagataatcccaaaaatctagctactcaaacagcatacagtaatcagcagactatgcaaatttttgaggaacgggtccgggatgcattagctaagaataaaaaggttatttaccgcgtctcgactgtttttaaaggaaatggattaatgccaactggctaccatgcagaagctatttcaacagatggatcgttaaattttaacgtttttgtttggaatgtacaaccgggggttcaatttgattatgcaaccggacgatcacgagtggatcgtagtatgacagtaagagcaaattaaagattaaacgattaatcgatatgattaatcgtttttttattacgttaaactttttaaattggagtggaagatatatactaaaaacataaatctatatgatatcgcttactttacgttagggggagacgttaatggaaaattcgaaagataatcgaagctttagatggtttaatatcgcactgatttcatttacagcagtttggggtcttaacaacgttgtaaataattttgctaatcaaggtttagttgttattgtttcatggatattaataatgctattatattttattccgtataccttgatggtaggtcaattaggttctacctttagagaagctgaggggggtgtatcgtcatggatgaaggaactttccaatagccagcttgcttattttgcggcttggacatactgggtggtccatgtgccatacttagcccaaaagccacaaactattttgattggttttagttggatgttcaaaaataacggtagctttgttaatcaaaccccatcttatgttgttcaaggattaagtttgataatctttttagcatttgtttggatggcttccaaaggagtgacaactctgaaccgaattgggagtattgctggaattgcgatgtttatcatgtcaattttattcattattttaggaatttcagcgccatttatcacgcattcagctattgccacagctcacatggatcaatttagtacatatatgccaaaatttaattttaattactttacaacgatttcaatgctagtttttgcggttggtggtgcagaaaaaatttcaccatacgttaacaaaaccagaaatccagctaaagaatttccgttgggaatgattttgttggcaatcatggtggctatatcagcaattttaggttcttttgcgatgggaatgatttttgatgcacaacatattcctaatgacttgatggccaatggttcttatacggctttccaaattttgggtaatcaatttcacgttggcaatacattaacttggatttacgcctttgctaatatcttggctaattcggcagctttagcgatttcgatcgatgcaccactacgaattttgttaaatgatgcggatagtaattatgtgccagcatttcttactagaaaaaatgctaaaggaattgcttataatggttacaaattaactgcaattttagtttcaattattattattgtgccggccttaggaatcggcggaatgaatgatttgtataattggttaatgaatttaaactcaattgttatgccaatgcggtacctttgggtatttgtggcctacatgttattgatgaaacaaattaataattataaatctgattacgtatttgttaaaaatactaagattggttttggttttggactatggtgctttattttcacagcttttgcatgtattttaggagttattccaaaggctgattttgcagctaatccaactagctggtggttccaattagcgcttaatattatcacaccatttgcattaattattttaggattgattttaccggttattgcacggcgaaatcagaataagttagattaggactgaaatttttaattttatattagagaatgagaaagggaaatccaactcgtggcggagttggatttctctttttttatgattcaactttacaattcaatttttttgaactaaaattaattcatatgcgaatgtagtttagtggtaaaattcaagcttcccaagcttgtgtcgcgggttcgattcccgtcattcgcttcactgaaaaacaaaatagatttatttaaacaagaaaccctactatcaactaaagatagcagggtttttattataagttattttttaagattgaaagtaactgtatcctcatcttctaaaatagcagaatattggtaatacagtttcttttgaacgtaagctgctttccatttttgagatagaaaggacatcaagaaaagggatgcagtactggtgatgcccgctaatccagcaaacccaacgtcaacccaaggcgcattagcgtcgttagatttatttttggagagtagggcttttgagacaataattttaggagtctttgtgttaatccttttttttaaatcaccagtacttgtaatcatagcgatcaatcctttctagttaaatataattgctcacctgcattataacactatcgaaaaaataaactgtgttaattttatttaaaaattaattttttgagggcgtttttaatgccatcagcgtcattagaactggtaatcatatcagcatgggatttggctaaatcggaaccattctccatggcgacggccgtaccaacaaaatcaaacatcgggatatcgttttgctcatcaccaaatgcaatgatttcttcagggtgaatacctaatttttcggagagagttttgagagccgcccctttatttacatttttatgcataacttcaagaaaattatcggctgctcgaaccacataacattgatcatcaaaggcagcatgaacagcttcttctacttgatttaactctgctgtttcaccaacaaaaatgcccttagtaatggtgaaatcagcaggaagttgatcaggagttttaattaataagccagctttattttcccaagcctggacaaccgtaaaacgattgacttcaaggttactggtgtagatattgctgtcacgatccagtacgttataagcaacgtgatattttcgagaaaattcatccattgctcgataaactgagttggaaagttcatgacttgcaattacttcaccagtcacagattcgattacagaaccgttataagtgatgacgtattggtcgtctgcggtaatacccaattcatttaggaaaggctttacaccagcgagaggacgccctgaacagagcacgactttaaggtgattttgaagacacttagcaatgatatctttggtggatggtaatagtacgatatttgaatttaacagggtatcatctacatcaatagcaattaatttgggagtcataagtagtcctactttctaagttttatctatgtataagtatagagatataaagttgatagtggcgttttttatgttaggaacattttccaaaaataagattcggatttgacgaaaagaaaataaattttttatatacaaatgaaattttcaaaatttttttcaaaaaaccagttataatagagggtagtaaacatttcggaggactaaaatgactaagcaaacatttgaatttgatagcgaactagaagtaaatcgtttaggttttggagcgatgcaattacctggtacaggagtttggggaccaagtacggatgaagaaaatgcagtcgcggtggtaaaagcagttttaaatagcgatgttaattttattgatacagcagactcatacgggcctttttacgctaatttatatataaaagcggctctaaaggattatcaaggaccgcataagctaattgctagtaaagttggtttcacgcgtccaggccctaatcaatggtctgtagtgggtgatccagattatttaagacaacaagtagagttaaatttacgtacacttgggcttgatagtatcgacttaatgcagttgcatcgagttgatcctcgttttccaattgaagaacaagttggtgttttagcagatatgcaaaaagaaggtaaaattcgtcatatcggcttaagtcaagtaaccgtagaacaaatcaaacgggctcaagctgttgctaaaattgcatccgtccaaaatcgctacaatttaattgagcgtgatgatgaagatgttcttcaatatgcagaagaaaaccacatggcatttattccttggttcccactggcgactggtagattagctcaagaagaacatgggattttatctcaaattgccaataatcatcttgctacgccaagccaaattgcattagcgtggctgttgcaaaaatcagatgtgattttgccaattccaggaacatctaacattcaacattttgaaagtaatatccaagcagcttacattacactttcagatgctgaatttaatgcactagaacaattataattaagtagtggaacttcatagaagagtctgatataatgaatcggtaattagtagggtagtagtaggctttaatcttatctaagcgagtctgagttggtgtgagtcagatataaggtaaagttgaaggcgtgaccttatggatattaatttaataaataagtggattatttaatcaattagagtggtaccgcgggaaatctcgtctcttacatttttacgaatgtaagaggcgttttttatttcgcagaatggaggaaaaaatggattataagaagaaagttgctgctgctttagcacctgcactaaacgagtatcttactgatacagaaatttacgaaaaaattgaaattcctaaggaaagtaagatgggtgattacgcctttccaacctttaccttagctaaggtattgcgcaaagcaccacaaatgattgcgagtgaattggttgaaaagattgaccaagatcaatttgaaaaggttgaagttgctggaccatatattaatttcttccttgacaagactgcttttggagcagaagttttaggtacagttttaagtcaaaaagctgaatatggtcaaaatgacgatggtaatcaaggaaatgttccaattgatatgtcatctcctaacattgctaaaccaatctcaatgggacatttacggtcaacagtaattggtaactcattgtcattaattatgagtaaaaatgggtacaatccaattaagattaaccatcttggagactggggaactcaatttggtaagttgatcacagcttacaagctttggggtagcgaagaggaagttaaagcagatccaattaacaagttacttgaatactatgttcgtttccataaagaagaccaagaaaaaccagaactagacgacattgctcgagactggtttaagaagcttgaagatggtgatgaagaagccatgaacctttggcaatggttccgtgaagaatcgctaaaatcgtttaagcaaatttatgacaaactaggaattacatttgattcatataagggtgaagctttctacaacgataagatggatgaaattgtccaaattcttgaagacaagggtctgcttaaagaaagccaaggagctcaagtagttgacttagagaagtacaatttaaatccagcattaattaagaagacggatggagcaaccctttacattactcgtgatttagctgctgctttgtatcgttaccggacttatgattttaaccaatcattgtatgttgttggtgctgaacaaactaaccatttcaagcaactaaaggctgttttaaaggaaatgggcttcgattggtcggatgatgtacatcatattccatttggtttaattaccttgaatggtaaaaagctttcaactcgttcaggtcgggttgtattgctggatgaagttttaaatgatgcagttagtttggctaaaaaacaaattaacgataagaacccggatttggctaatgcagatactgtagctaaagaagtcggtgtcggtgcggtaatcttccatgatcttaagaatgaaagaaccaactcatttgatttcaatctagaagatgttgttcgttttgaaggggaaacagggccttacgttcaatatagtcgagctcgtgctgaaagtattttgagaaaagctggcgatgtcgaagaattcgctcaattaaatattacggatcctaaagcttgggatactttgaaagctcttcaaggtttccctaatattgtgaagcgagcagctgctcaatatgaaccttcggtaatcgctaagtatgccctaggtttagcaaaggccttcaacaaatattatgctaactctaaaattttggctgacgatgaagaaaaaacagctcgtttagcattggttaagagtgtaagtattgtactagaagaatccttacgcctattaggagtaaaagctcctgacgaaatgtaataactgaactaattttaaaataaaaaagtgaatatttcgtaatttataaatgaggaccgcgttcaaaatgatgttttttggaccggttttttattttctcataaaatactcataattttaatcaagatagcgctttacaaatgaattacacctttttggacctaaactacacgatttggactaaaaattacatattaaattctgtttttgattccgttagactgtttacatcatcaaaatcaaacttatttggaggaatttaagcatgataaataatcagttggagttagaggttaagagtttcttagaaggacaatcagattttgctaacttacctagttcggaaattacacgattgagtcaggtgatcagaaagaaaaaaattcgccaaggacagtggatttttgatcaggaggatgaatttgaatatgtatttttgatgaaggagggacacgttaaaatgttttcgatgaatctagaaggggacatgacttctgtctcatatatcgttccgcagatggtttttccactgcgagggatcttgcaaggccgaaaatattgctataatgcagttgcaatgtgtacctcagaagtttacattttacccatcaaagagatgcgtaaaattattgttcatcattacgcttttacgatggcatttatgagacggatggagcaccaccttcaccgttcagaaaaactattagaaaaaacaacgtgttctagcgcagctcaacgggtgcgtcaggtattagattatttaaatgaagactatgcgcagacgcatggtactgttaagaaggtaccttttaaaatatttttgaaagatttggcggttttgagtgccactacgagtgaaactgccggatcggtaattaaagcaatgaaagaagaaaagaaagtgctgtataataataaaataatttcgtttatataaatattgagcggagcgtgaagatatgaaaaaagaattacgtcagaaaaaaatattaaatttaatttctaaaaaaaatattgcaactcaactagaattaattgatgcactagcagaaattggtattaaaaccacgcaagcaacgttatctagagatattaaagagttacatctagttaaaaaaacagatattacaggggaggtcgcttatcgagttttaaatgcagaagaacaagtcgaatataatagtggacccgttcgcgatatttttaaggaaagtgtaaatggtattacacaagtacaatttattaatattatccaaactgatccaaatgacggtagtcgggtagcagcggtaatcgatgacgcagaaattgatggagttaagggaacattagccgggtatgatacactggtgatatttagcgcagatgctgaagcggccgaagctttgcatcagaagttaaaatcatttttagaataaaataggttattaagacgaagttaaaaagggcaatcaacctcggtagaataacattgatatgataaactattaaagtatcgtaatcagcaacgaggtaaatgtatgaatatgaaaaaaatagggagtgcgattaaagcattcttacaaaagattggtgcatttttaaaacccgtgtgggataaaattcacccgttcatccataagtactggcacagatatcagcttacgcgatggattattgtagtagttttagcagttgtatttttctcaagtgcgattttaacttatcaagcgaagactgctaatgtaaaaaatttaaaagcagctttatcccagcctactttagtttatgataaaaataatgctaaagctggaagtttatattctcaaaaaggaacctggacaaatctagataatatctcacctaacgttcaaaatgccgtcattgcgacggaagaccgaaacttttataaggaatatggtttttcaattaagggaatcggtagagcgtttgtgatgtacggggtcaataaattacttggtcgagattatatatctggtgggggaagtactttaacccaacaattagtaaaaaacgcctttctatcacagcaacagacctttactagaaaggctaaagagttatttttatcaattgaagttgaaaatgtttattcaaaaaaagatatcttagcaatgtacttgaataacgcctattttggaaatggggtttggggagtacaggatgctgctgagaggtatttcggggtcagtgcttcggaactatcggttccccaagcggcaaccttggcagggatgctgactaatccgagtggctataatccaatcgatcatccaaaaaatgctttttcacgccgtaatgtagttttaagtttgatggcggaaaccggtaagatatccaaggccgacgccaaatcctatgctcaaacagctatctcaaccagtgataattacaatagtgaggacggttataagtatccatactactttgatgcagtaatcgatgaagccattagtaagtatggattgacggagtcggatattatgaatcgcgggtataaaatttatacgtatctggatcaggatagtcagcaaggtatgcaagatacttttgacaactccgctaattttccggttgatgctacggatggtactaaagtacaggctgcatctgttgcagtaaatgccaaaaatggtggtgtagaagcggtagttggtggtcgtggtaatcatgtctttagaggctataaccgtgctacccagattaaacgccaacctggctcaaccttaaaacctattgcagtttacgcccctgctttagcgagtggatatagttatagttctatgttagaagataaacttcaaacatatggaactaataaatataaacctgaaaattacaataacgaatatgcaggaaagattgcgatgtaccaagcacttgaacaaagtaaaaatgcgcctgcggtatggttattaaataaaattggtgtagataagggttacgattacaccaagaaatttggcttgaatccaagcaaagatgataagaatctagcgatggctcttggtggattgacgaatggtgtatcgccaattcaactagcttctgcttatactgcatttgctaataatgggacgttgtcgaagactggatttattcgcaaaattgtagatgcttctggaaatacgatcgtaaataacaccacggaatccaaacgagttatttcaaaaaaggtcgctaaagaaatgaccagtatgatgttaggtgtttatggtaacagttctggcacaggttatggggcagaaccttctggttatacaattgctggtaaaacaggtagtactgaagcagatacaggaactagttcatcagatgcaacccgtgacaaatggatggtaggatatacaaaggatgttgtagttgctacttgggaagggtttgatgacacaaacaagacccatcatctggaaaatattacgggagtcggcatgaatagtgtgttcaagagtgaaatgagtgccattttaccaaatacgaaaggtacttcattcgacgttaaatcagcttctaccctagctaatagtggaaacaatgttacctcaaacgtttgggataatattgaagacggaacttcttccatcacagatagtatttctcgaggagctagtggggtcaaagagaaagcgggagaattcttcaacgaagctaaaaagttcattaccgggaattgatttttatattaaaaacaagacctaaatgatataattaagatgttaatttcagaggaggcgtactatggctgtaaacatttatgatactgcaaaccaaatggaacaagaaattcgccaaacaagtgagtataaaagcttgcaagaagcttttgctgaagtacgaaaagatgaacatgctagtgtgttgtatagcaaatttcaggatgttcagagtaatcttcaacaaaaacaaatgaacggtgaagaactaacagaagaagaaatcaaaaatgttcatgaaattgcggatcaaattgaaaaagtagatttgattaaggatttaatggataaagaacgtaatatgaaccaattgtttagcgatgttagtcaaatcatcgttaaaccaatccaagaattatacaaaaactaattaattgcacgtgacaatctttttgttatgacgctgtgctataaaaaattgggactgtaagacaaaaaaatgtcgcagtcccattttttagtttctgggaaagtagaggaaaaatatgaaatttattcatgcggctgatatccatttagggagtccgtttcaaggattaaaaaatattccggctaacatccgtaaacgcgtggttagttcgaccggggtggccatgaaaaacttggttcaggcagccattgaaaatacagtggactttgtctgcattgcgggggatttatttgataatccggaaccggatttggaaactttaaaccttgccatcgatcaactagaaattttaaatgctgcaaatatcccagtatttctaagttatggaaatcatgattatcttaatgctaaaatacctggagcaatttttccggataacgtaagtatttttggagaagaagttgaaaccaaacaaataacgttggtagatggctcaacggtggatataacaggctttagttataataaacgcgcagaaattaatgctcggattgaggaatatcctagcaaaaataaccaagctgatttccaaattggaatgttgcatggaagtatggacggtctaaaatcgagcgaagcccactacgcaccttttacaatttcacaattgttagctaaaaactatgactattgggcattagggcatattcataagcgacaaactttaaatgatatgccggtcattgcctatgcgggaaatactcagggacgtcatattaatgaacccggcccccgtgggataagtctagttaccattaaccaacaaaagcaaactgacgtccaattcttaagaaccgatgttgtagaatggtctaatgtagcagttcaagcgcaaaaagggatggatttacaacaaattatttcagcgattattcaagcggtcgaacctttagcagcgcaacaacttaaattagttaatattaacctacagaatagtaatgttttaacaccagaaattttagatgaacttaccagcggaattgttttaactcaaattcaaaaacaattagaccaagaggtattttgggtttatcgaatttctttgaaggttaataataatattcggattttttcagaattagaccaagcgtactgggaaaaagcgaccgccaatgtttttaacgaaaaaaaagttcaagaaaagctcggcaggttaatggaacttgattttatagcagaaacctatggaaatgatttagaacttaacccgttgaaagaccaagttgaactaatgttgaaacaacggaatgctcttggagacgaacgcgatgaaaattaataagattgagatttatggatttggaaaatggaataacgttattttcgatttgaaacaagatttgcaagttttttatggtttgaatgaagctggtaaatcaacgctaagacaatttatttatagtattctatttggttttgctggtggtcgtggtaatcataagtatttacaatatgtacctaaaaaagcacaaggtgcagcaggttacggaggcaatttggtagtagaatatcaaggaaaaacttaccaaattgagcgaattaaaggtaaaaatggtgggaaagtaaatgttaaaaatatggatgatggactcgaaatgaatccagaatttttaacagagatgcttggccccattgaccaaaatgcttacgaacggttgctgggatttaaccagagtgatttggacgacttcaatgatttaggcaaccgggatgatttacgaagacatattctgcgaatgggcgcagtcggaagtgatgagtggattaagctcgaaaacgacttaaaaaaggaagcggataagcttcatactgccagttctcgaaaacgagacctagatcttaaaatcaagcaatataaagaagctgttgatcagcttcaagctgataaggccaaactaccagattatcaggtaacgaaagacttagaagaagccagtcaacaaaagttgcagcaagttcggtcggagattgcaaaattaaatactaaaattacagaaaccaataatttgattaatacgtggcctacatattcagaaacattggatttaaagcaaaagctgcaagatatccccgaagcatacttgaatttagatttgaatcagttggaagttttagccaaccagatacgtgaaaatcagaatgaacttcgtaatttacaaagtcagctagaggatttaccaaatgagaaaaacaatgtaattgatataactaaattagacgaactacaaagtaagctaccagaagtaaaattgaattatggtcagttagaggacttgaaacatagattcaatcgattgaaccaacaacttgaagaaattcaagcgcagtatcaagttgaccttggtaatcttaaacccatgccagaaggtcaatttgttgaattaaaggacttattgttaaagcagaaacgtaagaatgcggatattaatcaacttaaaacacaaatgttagaaactacgggaagtcgttcaacgcatacgaattctaattccaatgtagtaattggcgcagccgcggtactggtcgtaattgattttttaatcccattaaactggttatttaagttgatcttgctagcaataattattggtggtggatatggtttaacccatgctaaatcagcagacaacgttacacctaatgaagagaatttagaagatgttttgaagcgggatgaaaccgaagctgagcaaattaaaactgcaatcaagcaaattggtgataaaacaagctttaacgcatttccagtggaagattgggtagcattacaatctaacttattgaactaccagcatttggttaatgaaatgagcgaattaaagggacatttaacccaaatcaaagaacaacttggcactttttgggaattcagcgatggaattctcccagtggatgaacatcgaaaagaagctctacaaactttgatcgatcaggtaaatggaatggttgagcaagatcgaaagcaacaaagtatcagccaacagcgtcaattacttaataaaaatgtggcggaacggcgtaccgagttagataaattgcgaattcaatttaaacagcttaatggacctgaaattaatgctgattttgatgattggcttaagcaagttagaacagcccaacatttaaacttaagattaaatactttattggaatctaaccaagttaagttttttgaccaactacaacaatatgcagatttaacaaaattgcagcaacttcaaaacgaacaggaacaaaagctggccgagtttaaacaagctgagcaagatattttagaccaacgtgctaatcaactaggtgaacttacgggtcttaagagtagtgtagacatcctagctgaacaacagttactatcagaacaagaaaccgaaattaaagatctggtttcagaatggttaactttgcagctaggtgctgaatgggtcgatcaaacactaggagtagctactaagggacgtttaccggtaatccttgataaggcaaatgagtactttagacagataactaatcagcgttaccaaaaaattgaatttgataaagatgatatgattaatgtaacggatgaaactggaaatgtatttgaaattggtgagctgtcaaaaggtacgatggaacaactttatatttcaattcggtttgcctttatgcaagcttttgcggatacggtaagattaccaattatcattgacgatgcttttgtagcgttcgatgatgttcgtttacgacaagcctttagtttattaaacaaaattgcagaacaaactcaagttatttatttttctgccaagaaagaagtttatgacttaattgatgaccaaaaaattattaatttaaatgaaaaataaaagggggagatattttgacgaaaaaaataaccgaatttcaaaatgatgaagaaatggaattatttgtcttaatcaaatctgcggaaaagcgggtgaccaaagctggaaaagattttatttcgatgaagtttcaagatcgatctggagacattcatggaaactactgggatgctaaggaagaagattttaaaaatttccaacctgggcgagtagttcttctaagaggaaaaagagaaacttataagaatgctccacaagtaaagattatggcgatgcgtttagctaccgatgaggaaccaaacgatcctactgcttatactgaaaaaggaccggtttcagctgaaaaattgcgagaagaatttacacaattgatgtttgaaatcaacaatccagattggaatcgagtggttagatatttattgaagaagtatgaccgcgaatttttcagttttccagcagctaaaactaaccatcatgcttttgagggtggtttggctttccacacactttcaattgttaatttagctaagtcggttgctgctcaatatgaacaagtagatcaatctttattaattgcgggagccatcctacatgatctaggtaaaacaattgaattatcagggcccattgcaactcagtatacggttgaaggcaatttgttagggcacattgtcattgtcgacgaggagattgtggaagcagctaaggatttaaaaattgatccgagctctgaatcaatggtggtattaagacatatgattgttgctcatcatggtttgaaagaatatggttcaccagttgaaccgcacatgctggaagcagttattttacacgcattggacgaacttgatgctgaaattcaaatggtatctggagctttgaaaaatacacaacctggagctttcagtgaacgaatttttggtatggatggacgtaatttttataaaccagaaagcaaataaaaaagatgaacgagaaatcgttcatcttttttatttagcattatttagtacttgagctagcagagctaccaaggtaatcgtcaagaacattcttaaggtctttgtccttaatagttacgttacccttcttaagaactttagtgattacactacgtaaagttgtgctatcgctcatatctgcattccagatacgttctttaagttctttagtatggtcagacatcttacccttagatggtttgttaatcatcttaatcacttggtaaccatattcagttttaactggtgtagttgtatatttaccttcatcaagcttgaatgcagctttcttgaaagaagagtccagtgttgagtttgtgtcatcaaaggcagcaattttaccacccttattcttagttgaagaatcagttgaatattgcttagcaagtttagtgaaatctccaccatcgttaagcttcttgataacatcttcagcagttgatttcttagaaactaaaatctgagccactgtaacctttggttcataagatttccattctttcttaaggtctgcatttgaaatcttatcgttagctttaacggcttctttcaatagcaggttagaacgaatctgagtcttcaaagaagaagttgtcataccattagatgaaaggatgctcttaaatgatgatccatattgatccttgtatgagttgtattgcttagtaaccgtctttttagaaactttatcaccatattgtttttctaaaactttgttgacgatcatttcttgaagaacttgcttaccactagtggtgttcttcaagctgctgtagtattcgtcttgagtgattttaccacccgatgttgtagcaaccgtcttatttccacacgctgctaaggtaaatgccattgcaatactggcaaaaccaattaaaacttttttcattacaatccacacatcctaacaatttaatttgttaaatacaaaacctatcataccatacctaaatggatgataataaaacaactttaatctttagaaaaagttttaatcattttctttttttatccaagatttggtcttgtaaatgatcaatttcgctatttatgtgtttttttagttcattaattttttcaatgcgagggtcgagtttatattcaaaacgatccaccgatttagtaatttggttaaccgttcgctcagctttttttaattcaacttggagttgagccgagttagcctttaaactttgaagtgagtcaacaaattcacttaaattggtaaagtattccttcatcgatattttaaaatcacggatgaaatggggatggttaagaagatattcgacacctttaaaaccagcccaagttccgatggaccactttaaccatgaatgcttcttagttttttttgccataattaatcacctaaacgatcagtaatctgtttttggattttttgaagttcctcagaactgtatttatcggtgttatcagtaaaggtcatgctgaaaccatcatccttggtataacgtggaatcaaatggaagtgagagtggaagacactctgataggctaattcgccgttattattaaccacattcatggctttaatgtcaggattgctagccttgatggccgttgcaatcttaggaattctggagaagacgtctgctgccagctgggaatcataggcaaaaagatcgggaacatgttttttaggtaccaccaaagtatgtccaggtgttacttgagaaatatcaagaaatgctttaaccacgtcatcttcatatacagtataactaggaatatcgccagtaattattttacaaaatacacaattttcatccattatttctacctccaatttataattaattatacatgaaaaaggagggaatgtatcatcatagcaatatggttaaagaccgatatgttataatttatggagattttcaaaatcttttttagacgattggggatttaaatttgacactatcaattgagcacttaacgggcggttacacacaaacgccagtcataaaagatattaattttgaagttaaaaatggtgaattactaggattgattggtctgaatggagcaggaaaatcaactacaatcaatcatgtcattggattaatgcgtcctatgaagggtaaaattattttagatgaaattgatttggaacagaatcctactcaatataaaaccaagcttgcgtatattccggaattacctattttatatgatgaattgacgttgaaggaacatattgaactaacgattaaggcttacgaaatgaattcagaaaaagcatggcagcaagctcataaacttttaaaaacctttcgattagagaataagctagactggttcccagctaatttttcaaaggggatgcgtcaaaaggtgatgattgtttgtgcctttattactgacgcagaattatttgtagtcgatgaaccttttctagggttggatccgctagcaattgatgaccttttaaaggtgattaatgaaaaaaagcaacaaggagcttccattctaatgtctacgcatgtcttagacaccgctgaaaagtattgtgatcgctttgctctcttaaatgaaggtgaattaaaagcggttggaacgttagctgactttcagaaacaatttaatttaccgaactctagtttaaatgatatttatttaacaattgctaagggtgagcgcgatgaatgagttatggaacagtcgaactaagcaatatcaaaaaatgatcatgcgatatttaaaatatgtattgaatgatcatctggttttagcgttgctatttttcggtggtggaattggtttagcatattcgaattggttaaaagaaatccatccaggaacctggtatatcaaacctttggttttaattggaggcgttttgctaactttactaggtaaccctgtcctcctactaaagctgccggataaagttttcttggttcctaaagaaaaagatattcatcaatatttagggaaatcggtcaaaagatcattaatctcagtggtattgccaactttgattggtaatattattttatttccattattagcattggaatatcaccatgttgaagcggcggtagccattacggttactattttcttgggaagtatggcaaatgtcttgagaaaatatcaaactctatactttgataccagcctttcacaaatgtggtttcatttggtagtgatgttgattgctgtaggactaggtgtttggtttagtccgatgggtggattaatattaatggcgattaatttgatttttagagttgtacttttgaatcaggttttcaaaactaagcggtttaactggaatcatgcaattgacttagagaatagtcgaatgcagcgcttgtatcatttcttcagcttgtttaccaacgtcaagcaggttggtgcagaagttaaacgtcgaaaatatgcggatggcttggttcatattttatctgggaaaccaaccttgtttacttatttatatcctagaataatgattcggagcggtaatcaagggagtttgatgttacgtctattactattagggatggttattgaaggttatagtcagcagattccgttaaaggtaattgttggtggactaacaatctatttaatggttatccaaatggtagacatttatcgtcccgttcacgaaaatgtatttattaagatctatcctgttagcccagatgcagcagaaaaagacttgttatctgttatgaaaagaatcatacttataagcgcgatatttttaacattaattggactgataagtaacttatcatggaactttttagttgcatcggtggtaacacaggggattgttgcagtgattttactcaagtggttcataccacgttatataaaaaaattaaattaaatttaagaggtaattatgcgagttagaaataaaccatgggcaccggagttaatcgaggctcatccagaaaagattgttgaaaagggccaagcgttcaagggtcaatggaaccagcggtttgaaaaagaacaaccaatttttattgaagtaggaacgggtaagggtcaattcattattaatatggccaaaaaatatcctcaatacaattttattggaattgaaattcaaaaaactgtaattgccattgctttaaaaaatgctttggaggaagaaattcccaatttgcaattcttatatgctgatggcgctgaacttacggattattttgaagatggtgaggtttccaaagttttccttaacttttcagacccatggcctaaaacacgtcatgaaaaacgccggttaacctttaagactttcttgaaagtttatgaacaaattttagttaaaaatggggaagttgaatttaaaacggataatcaaggattattcgaatattcactttacagccttaataactatggaatgacttttgaaggcgtttggttagacttacacaatagtgaagaaaacgaagataacgttgaaactgaatatgaacataaattcagtgctaaaggccaaccaatttacaaattaaaagcacatttctaaagtgaaaaataaaaagagtctgaggatttttcctcagactctctattagtttgctattatcgacgataaatatcgataatggtaccagtataggcatctgcgataaattcgtactgaataagttcattgttttcgtacttggtgattccaccataataaactgaagctttaaggccatagcgattaagaggagacggctttgattcaatccaagcgccctcaatggggccatcgtcttcaaaagaacgtcgtacccgagctaaggcagattgtggtcttactttgcggtgttccttgatttgatatgtaactaatgaacccagcgcaaaagttccgattgcggtaagcgttaaaccgagtaatgcagatgatttagatgacatgaaaccacttccttttctactaattctaacattagtaagaaggttttgagaattaaaaagtatatattttaaggagaaaataatgttaattgctagttataataaagaaaccatgggagatatcctaattacgatgattcgtccagatgctgaggaagcaaaaattgaacaaaaaggctccgtagttcgaattgccaatgctaaaacaaatgaaaccaccggttttaatttcttaaatgtcagcaaaatttttgaaatcaatggtaagggtcccattactttgactcaagaacaagtaaagcaacttaatgccacattatctgctaatggttttgaagctgaattagtagcagatgaacgtccaaaatttgtcgtgggttacgtgaaatcaactaaaccacatccagattcagatcatttgttaattactgaaactgaggtggataatggtgaaactttgcaaattgttagtggttcacctaatatgaccgacaatatcaaggtagtagtagctaaggtgggagcaatcatgccagatggaatgattatttggccaggcgaacttcgtggcgttgaaagtaatggaatgatttcctctggaagagaattgcatttaaataatgcacctcagaagaagggagcattaattttacctgatgatttcgttgtaggtgaagcatttgattttgaaaaaggtaatcatatctttgattaaagaagggatttagatggttaaatatgatgggcctgctttttttcgaaaaaaaggcgtagattttaataatccaagtttaaatattcaagaagaccaaacttcgaagttaaaaaatgaggattttacccctgctattaaacggcgtaaacaggttccagagaccatttcccaagcaaaattatcgcaggcggtagatcccattcaaccaacgttggctaaagatacacctgaaccaactaaacaagtggtagagaaaactgagcatcgacagcctcgttttagaatgccccgtacaaaatatgaggcaccgaaacgtccagcaaaggttatgcatgaaattaagcatcgacaccagcttgagaaaagtcatcatgaacttgatgaaaatattacaccggtgatagaaaaaaacgtaccgaaaacgatggttgaaaaagctgtcccaattgaaaataataatcactttgaagagcaaccgccggaagaaaatccaaggcagtcatttgaacgaagtgaaactaatgaattcgggtatcaatttccaagtttgaatttattacctaatccagtaattgacactgataatacggacgagtgggttaatgatcaaattcaaagattgaatgatgccttattagcgtttgatgttgatgctgaggttgtaaattggactgtgggcccaacggtaactcaatttgaaattgaactcggtcgaggagttaaagtcaataaaatcacgaatttaacggatgatttaaagctgcagttagcagctaaggatattcgaattgaggctccaattcctggtaaaaataccgtggggattgaagtacctaatttgcatcctcgaccagtgcctttaagtgaaattattagttcagataagtttaaagcaagtgagtcaccattaaccgtggctttgggagttgatttgtttggtcaacctcaaacttatgatcttcgcaagatgccgcatggtctgattgctggtgccactggttctggtaaaagtgtttttattaatagtgttttggtgtcgttgttatacaaagcgactccccaagatttgaaactactattaattgatcccaagacggttgagttagcgccatacaatggactgccacatttgcttgctccagttatttcagatcctaaggccgcctcggcttctttaaaatgggttaccaaagagatggatgagcgttatgaaagactggcgactgcaggtgctcgcaatattgagcagtataataaaaaggccgaaaaggcccaagattatgccaataagatgccgtacattgtagttattattgatgaattagctgatttaatgatggtttcttcttcagaagtacaggattacattgtacgaattacgcaaaaagcacgagcagctgggattcatttattgattgcaacccagcgacctagcgtggacgtagtaaccggattgattaaaaataatattccaacaagggtagcgtttatggtatccagtcaagtcgattcaagaacaatcttggatcattcaggggcagagcgactcttaggaagaggagatatgctgttccttggaaatggaaagagtaatccggttcgtctacaaggggcctttattaatgaagaaatcgatgacattactgattttgtccgagcacaggctgcgccacaatatgctttcaatcccaatgagttgaaagtccaaagtgaagagttggatagcgaagacgaattaatggatgatgtacttgaattcttagcggatgaggaaactatctcaacatctaaattacagagaatgttttcaattggatacaaccgagcagcaaccattatggatcaacttgaggcttcaggatatatttcggaagctcgtggttcaaaaccacgggaagttttttatgatggaaacaataacgaagtgtagtgtggtaaactaaaaacaatttaattataggagtggtaaaggtggataaagattcaacttattattttatcggtattaaggggtcagggatgagttccctagcacttattttgcatgacgagggatacaaagtagaaggatcagatattgagcaatatacctttacacaaaagggcttagaagctgctgggattaagatattaccttttgatccggccaacctacgtgaaggcttgacggtgattgctggaaatgcatttactgacgaacatcctgaaattaaaaaagctagagcaatgggtctaaaagtaattcgttaccatgaacttctgggacaaatgctagacaaatacactagtattggtgttgcaggaacgcatggtaagactagtacaacaggattgcttgctcacgttttaagtggtttagacaagactagttatttaattggcgatggaaccggtaagggtattccagatgcacgattctttgtttttgaagctgatgaatatcgtcgtcattttattgcataccatccagactatatgattatgactaacgtcgattttgatcatccagattattataaggatctcgccgatgttgaaagtgccttccagcaggttgccgatcaagttcataagggaatctttgcttggggtgaagatgaaagtcttcgtaaaatcaatacatctgttccagtttactattatggaactaaggaaaatgatgacttccaagctaccaatattagtcgaacaaccacgggttctgaatttgatgtaatccataagggtgaaaagttaggtagatttacaattaacctttttggtgaacacaatgtgctaaattccttggctgtaatcgcagtagcatactttgaaaaagttgatttggacctagttcaaaaagaacttttaacttatcaaggtgttaaacgtcgtttctctaaggaagcagttgctgataatattttaattgatgattatgcacatcatccatctgaaattaaggcgacattagatgcagctcgccaagaatttcctgataaaaaaattgttgctgttttccaaccacatacttactcaagaactgccgctttgatggatggctttgccaagagtttaagtttagctgatcaagttgttttaactgaaatttttggttctgcacgtgaagatgccggggctgtttcatcacaagacttagcagataagattggtaataataccaaattgattcatcaagatgatttatcggctattagtgatttacacgatgcggtattggtcttcatgggggccggagatattactaagtacgaaaatgcttacaaggcattatttaaataattattaagttttgatttgtttgactaattttgacctataacattagccatttgggtagcttcttgttacaatgtggtaaataatcgaatgggggaattagattggatcaaagaccaaatgttattaatacagaaataggattaaatcgatttctaacaaagatgtacggatggatggcagctgctgtagccttctctggagtgattgcttacctaggagccacaatctggcgaccagccgtaatgactttcctttctcaaggaagaatgagtatctgggtaatttttattgctttgttcttgtttatgatttttggacaaaaggcggccttgcagaatccaacggttagtttcttaatgctatttgccttttcggcattctttggaattacgttgtcgagtgtctttatgctttatagtaccgctactattgcgggggcatttttctcagcagcatcggttttcattgtaatgagtgtgatgggagtaaccacaaagcgtgatctatcaaggatgggtaaccatttaattgcggcattgattgcgatggtggtagtttcagtgattaatttattcttccttcacagttcagccgtaactttcttcttctcaattattggaattgtgatttttgcgggtttgtcaatgtatgatactgcaactatgaaacgtctttacctgaactatggtgaccaagtttctgagactggacttgcaatccaaggggcatttagtctatatctagactttattaacctcttccaatacttcttaactatttttggatggaatcgagactaaataaaaattttataaatacaaataaaccgaaggtcaatctttttcacgttgaccttcggtttttggtatcattaaagaggatagaaaacggaggaaattatggcaaaagataaacttttattgattgatggaaatagtattgcttttcggtctttttttgcgttacataattctttaagtaaatttgtaaataaaaatggattacatactaatgcaatctttggtttcaacaaaatgttagatagtattttagaacaataccagccgacagcggccttggtggccttcgatgctggtaaaaccacttttagaaatggaaaatttgataattataaaggtggtcggtctaaaacaccacctgaactatcagagcaaatgccttatttacgtgaattacttacaggatatggaataaaatcttacgagcttcctaattatgaagctgatgacattattggaacacttgctaaagaagctgaagcccaagattatgcggtagttgtggttacgggagatcgtgacttaacccaattgagtagcgaaaaaacaatcgtcgccgttacgaaaaaaggggtaagcgaagtagaagagtacacaccagcgtatgtcgaagaaaaattaggcgtaacacctaaacaaattattgacattaaaggcttagctggagacacatcggataattatcctggggtaactaaagttggtgaaaagacggccattaagttgttaaaacaatttgattcattggagaatttgtatgagcatcttgatgaattaaaacctagcaagatgaaggagcatttgattgaagatcgagacaatgctttcatgtcaaaagatctagcaactattagacgggatgcaccgatagaaatttgtctcgatgatgtgcagtatgtcggtattaacgaagaatatttgagagaattttaccaccaaatgaactttaagtcctttttaagtaaattagatcaaacggcaactcaagatggagttgaggccgtgaaaaaagaggttgtttttaacgttttaaataaggacaacgtggaacaactccaatcattaaagggtgaaatcgatttttatttggaaatgttggacaaaaactatcatttgtctgattttacgggatttgtgatcggaaatgccgataacatttgggttagtgatgatgtagaactgttgaacaattcaaaaatcaaagctattttggaagatcccaaaattaagataaatgtatttgatagtaagcggacgtatgttggcttacatcgactagggattaagctaacggcggttaactttgatatattgcttcaatcgtatttgttagatactaatgataattctaatgacctaggtcaacttgctcatgagcatgattacgatacgattgatacagacgatgatgtttatggcaaaggcgccaagcgtgcggttccagagcaaacagaattgtttaaccaccttgcacgtaaattagcagctattaactttttaggtaaacaattggaccaagaattagtaaaaaatgaacaaaataatttatattgggatattgaattaccactcgcaattgtattagccaagatggaaattagcggtattaaagttaaccgcaaccgcttaaatcaaatgcaaagcgagtttactgaacgcttaagtgaaattgaaaccaatatttacaacgaagcgggagaggaatttaatcttaattcgcccaagcaactcggagtagtgctgtttgaaaagttaaaattaccaatcattaagaaaactaaaacagggtattcaactgcggtagacgtcttagagaaattacaaggcgagtcaccaattattgataatattttgaactaccgtacgctttcaaaaattaaatcaacttatgttgatgggcttttaaaagtaattcatacgactgatgaaaaagtgcatacaacctatgtacaaactttgacccaaacgggccgactatcttccattgaccctaatttacaaaatattccggtgcgcattgaagagggtaggaagattcgccaagcctttgttccagctcgtgaagggtggcatattttatcatcggattactcacaaattgaattacgtgtattagcacatattacaggtgatcagaacttacaggaagcatttaaaaatggcgaagatattcatgctacaactgcagttaaaatatttggattgaaggatgctagcgaggtaactcctaatattcgacgtcaagctaaggcagttaattttggaattgtgtatggtattagtgactatggtttgtctcaaaacattggaatttctaggaaagatgccaagaaatttatcgaaacatactttaaggaattccctggtgtaaaaaaatatattgatgaatcagttcagttagctaaagaacaaggctacgtagaaacaattgcgcaccgtcgacgttacttaccagacattaattcgtctagttttaatttacgttcatttgcggaaagaaccgctatgaatacgcctattcaaggtagtgctgctgatattattaagattgcgatgatcgatatgcaaaatgaattagaaaagcgtaacttgaagagtggaatgttactccaagtgcatgatgaattgatttttgaagttccggatgaagaaatgacgttaatgaaagaattagtaccgaaggttatggactcagcagttaaattggatgttccacttaaagttggagcagcttggggaaatacttggtacgaggctaaataacgggggagaagtatgcctgaattaccagaagttgaaacagttcgtagaggcctagcagccttagttgaaggaaaaatagttactaatgttgtagtacgttattcaaaaatggtctcaccaaaagcggaaatttttgcagaagaactagagggtaaaaaaattcttaatgttcgacgacgcggcaaatatctattaattgattttagtggagattacacgatggtttctcatcttcgcatggagggtaaatactctgtagttgatcgtcatgaagagtatggcaaacatgatcacgttattttcgagcttgatgatggaaaagatcttcggtacaacgacactagaaaattcggtaggatgaatttggtacccacgggtgaggaattacaagtgggcggtttaaaaacgattggaccagaaccaacgcctgagacccttaccttagaatatttaacccatcagctacggaatcgaaaacgtggaatgaaaagttttctattggatcagtccatgattgctggtttaggcaatatctacgctgatgaagtattgtggctaagcaaaattcatcctcagcagatttctaatactttaactgatgaagaaattgaaattttgcgtgaatcaatttttgaagagttgcaattggcgattgaagctaaaggaacgacggttttttcttatttgaatgcggatggtcatgcgggaagttttcaaaaccagttgcatgtataccatcgccaaggtttgccgtgtcagcgatgcgggacacccattgaacggattaaagtggcacaacgtgggacccatttttgcccccattgccaagttttgaggtagtgatatgacagtgatagttggtctaactggtgggattgcaatgggtaaaacgacgattagccaatttttgaaatctaaagcaattccggtagttgatgctgatcaaattgcacacgaaatcttaacagttgatgaagttaaagtgaaattgatggatacttttggtgaaagtattctagataaaaatcaaaatattgatcgtcgaaaactaggaccaattgtattcaatgatcaaagacaattggaaaagctaaatataattgtgcaaccttatattcgaaccgaaatagtaagacaattggacaattttagcgcaagtaaggtagtagttttagatgctccggtgctctttgagcaaggatatgaaaaaatggttgattatttaatggtcattaaaactagtgctcaaattcaagtagaacgtttaatgcaacgtgatagtttaaatgaaattgacgctcaaaaaagaattcaagctcagatgcctatcgaagaaaaggtaaaaaaagctgatattgtgattgataccagtggaacaattgaagagacacgaagtcaagtggtaaaatggcttgttgacaagaatttattctaagcttccgaagcattcggcgaggtgaaacgaaatgaaatgtccacactgtggaaataatggatcaagagttgttgatagtcgaccaaccgatgaaggtcgggttattcgacgaagaagagaatgtgaaaaatgtggctttagatttaccacgtttgaacgtgttgaagcaacaccattactagttattaagaaaaatggatcaagagaagagtttgatcgagataaaattttaaaagggattgtacgagcagctgaaaaacgccccttaaacatggaacagatgacggatatggtcgataaggttgaaaataaggttcgttctttaggtgagagcgaaatttcaagtcaaattatcggcgaatatgtgatgaatattttagtagatttagatgagattgcttatattcgttttgctagtgtttaccgtcaatttaaagatatgcatgtctttttagatgagctgcaagatatgatgaaaaaagacgaagaaaaggaaaaagagtagatggcaactgagatgagtgaattagcaccccatgattcatttataattgatagccaacgtcaaattactgattttgagcaacgttcattgacgacactatatcgtccattgttgacctcagatgcatatagtttgatgatggttttgtgggaaatgagtcaggaaacccaatcgatctcagaacagtacacacatacaatccttttaaattggcttggaatcgatctaccagcgatagttgaggcacgaggacgtttagaagcactgggtctactaaaaacgtatcagagaaaaattgatcgtcgaagtttatttttgtatgcactccaagctccagccgatcccgttaaattctttaaagatgacactttgagtgctttattgctgggcgtgattggcgaaagtgaattcgatcggctgagtcatcggctgattaagcagcacgtgcgtcaggacgaattttatgatgtttccaaaaagctgggcgactattttcaattgggaagtagcgtaataaataaaccagatgcaattaatcaggttcagaaaagtttatcggaaaccgagcatgaagttgatacagaagttattaaccaagattttgattttaaattacttgcgcaaatgctaagttctagttttgtagatcatcagagcttgctagaaaatgaacatttaattatggttgaacagactatttatgggattaatgaaagcgaaatggctcagttaatcaaagcctctacgagttatgaagataacaaaattgatcctaaagaactaaagtcacgagttttgaacgcttataatgggcagacgccggttaaagatgatggaaattctcagcctaaaaacgagtcaattccgaataatgcactagctaaacttactacagaagaacgcgccattattagtgcaacctatgctatgtcacccaacgcatttattgaaagtttgaaagcacaagcagggggctttacaactgctgcagaaaaaagaattattacagatttagttggtaaagggttaatgccaattagtgtgataaactttttagtttactattttattgttgatcagggtcgacctacgttaaataaaaatttagtggaagcaattgccaatgactggattaaaaataaaattaaaactccagtggaagctttagaatttattcgtaaacgccaagaacaaaagaaaaatacgaacaataattattcgaaaaatcggcgtacgattcaaagagaaaccttacctgaatgggctacggagaccgctaagactaaagaacccaagcaagttaatccagaaacaactaaaaaaattaatgaacaacttaaaaaacttcgttctagaggcaaggagggatagtcatggaaaatgtccgagaaattttgcaagaattaatgagcaaaagaaagctcgaccagcgttttaataacgtgatgaaatcagtatattctgatccagaagtgattagtttttgcgaggagcatcaagacgaactatccaaggaagctatcgaacgtggagcggctaagctgtatgaatttgtttcagaacgaaataagattaaaaataaccaagcaacctttttaccgggatatcagccagaattagtcttaagcaatcatttgattgatattgagtatgtgcccacgaaacagactcatttattagaacaagaacgtcaccgaaaagcgttagttaaatcgattagtatgcctaaattaatccgtcatgcttcattggagggatactatcaggaaccagaacgaacagacgctttggctaaaactttagcgtttgtaaacgaatatttagaacgccctcaagattggcataagggtttgtatttgacgggaagttttggtgtgggaaaaacgtatctaatgggtgcaatggggaacgctttggctgatgaaggatattcgacaactattgttcattttcctagtttagctgttgaattaaaaaatgcgattggaagttctaatacgattcaaactaaaatcgatgcgattaaaaaagctccgattttggtaattgacgatattggagcggatagcatttcttcttggattagggatgacgtattgggagtaattctcgaataccgaatgcaagaagaattaccaacattttttacatctaatttttcaatggaccaattagagcgagaacatctaacagtcaatcagagaggcgaagcagaacctttaaaagcgaaaagattgatggaacgaattaaatttttgagtgaggaagtctcgatgacgggaaaaaatcatcgacaggattgacaaacaatcaaaaataggtagaataaatgtataaatcacagtcaaacatgtagtttttaattcagggagcggagccgcgactgcaagcgatgcacttaaaacttcccacttgactagaggctgggcgcaatcccagttcggttgccaccgttatggcttttaatcgagtggtagatagttttttaactgtctacaattagggtggaaccgcgtgaataataaatgacaatcacgtccctggtatttttataccagggacttttttgtacataaatttaaggagagagtgttatgacagaaattaatattgaatttccagatggcagtgtaaaaccttttgaacaaggcgtttcaattttagatattgctaagtcaatcagtactagccttgctaaaaaagctgttgctgggaaaattaacggtgccttggttcgtttggaccaagctattaacgaaaacgtaaaaatcgaaattgtcacaaaagattcagaagatggtaacatcgttaactggaattcggcagccttagttttgactagtgctatcgaaagcatctatcctggagttcattttggtgagattggcaacggagaacatggtttttacgttgatacagataaggttgatcaacaaatttcagttgaccaattaccagcaattgaagataagatgaaggacattattaaatctaagattagcttaaagcatagtgaaattagtgtagaagaagccctagcaagcgttgatggtgacccataccaagctaaaatcgttaagcgtaacgaaaaaaatggcaaagttagtgtttatgacgttgatggaaaaataattgttagtgataacgttgctttacttagcacttcagatatgaaagccgttaagttgttgtcagttgcaggtgcttattgggaaggtaagtcaagtaatccgatgctccaacggatttacggaacatctttctacaaacaaaaagatcttgaagcagaacttgaacgccaaaaggaagctcacgaacgtgaccaccgtgtcattggaaacaatttagacttgttcttcgttgaccctaaggttggtgcaggacttccttactggatgccaaatggtgctacaattcgtcgttccattgaacgttacattattgataaggaagttaagcatggttaccaacatgtttacactccagtattgatgaaccttgatgcatataagacttctggtcactggcaacactatcgtgaagacatgttcccaccaatggacatgggtgatggcgaaatgcttgaactccgtccaatgaactgtccttcacatatccaagtttataagcaccatattcgttcatatcgtgaattaccaatccggattgctgaattagggatgatgcatcgttacgaaaaatccggtgctctttctggattacagcgagttcgtgaaatgacgttgaatgatggtcatacatttgtggctccagaccaaattcaagctgaatttaaaaaagttcttcaattaatggttgaagtttatcgtgatttcaatatcactgactacacattccgcctaagttatcgtgatcctgctaatactgaaaagtattttgacgatgatgaaatgtggaacaagtcacaatctatgttgaaagctgctatggatgatcttggcttagattatgttgaagctgaaggcgaagccgcattctacggtccaaagcttgacgttcaaactaagacagcccttggaaatgaagaaacactttcaacaattcaattagactttatgcttccaaagcaatttgacctacattatgttggggctgacggggaagaacatcgtccagtaatgattcaccgtggattagtttcaactatggaacgtttcacggcttacttgattgaaatgtataagggtgctttcccaacttggttagctcctaagcaagttacaatcattcctgttaaagatgatttacatggtgcttatgccgataaacttcgtgaagaaatggtcgataaagacattcgagttgaagttgaccaccgtaatgaaaagatgggttataagattcgtgaagctcaaactcaaaagattccatatatcttagttgttggtgataatgaattagaaaataactccgttagtgtacgtcactacggtgaagatgattctaagaatgaagctagtgctgactttatcaacaatatcgttcgtgaaattgaaagttacagtcgcgaaaatgactaaaatagtttaattaaaataggatttttaatggtgtgaatatcattaaaatcctatttttttgtaggctttaataagggatgaccgttgaaaggcttataattatattgtgattaagaatggtagttttagaatgattaatgtaaggagtaggcatgttaaatttaaccgtacttttgtttgaaagagctggattaattattattttggctttttttctagtaaatattcctcaatttaggaaattactttttcgaaaagattggtcaacaactttccaattatttgcgattttttctgtttttacgattgtagcaaatttaattggtgttgaacttcgacctgataatagcattcaattcaaatcccttctgcagaatgttacccctggagattctgtagctaatattcgaattttaacggttacagtttcaggaattattggcgggccgctggttgggggtggagtaggcttagtcgctggacttcaccgaatgttgcaagagtcgctaacaaccgacgcccttttttgtattcccagttcgatgataattggaattttagccggtttttttgctaagaaaaaacaacatcgctttgcaacaatgaaagtgtttgatggttttttagtaggacctttaatggaagcaatccaaatgctgtttattttactatttagtccgacaggtaggactttggtaaaatatattgcaataccaatgatgctagtaggtgctttagggacttcggttttcttatcaattatcacgctttattttcggcaggaagttgatactcaagctacccaaactaaatcaatttttcagttagctttaaaaactttgccagtttttcgccaagggttaaatcaagaagccgctaaaaaggctgctagtttaatattggaatatacaaattttgatgcggttggtattacagatgaatctaagattctggcttttgcggggatgggaagtgatcaccatatcacaggtgcttctatcttgacggaattatctgaagaggcggttaaattgggtgaagttcaaattggaaataatgctcatgagattaattgccctgtaaaaagttgtccattacactcggctgttgtagtacctttaatcattaaaggtaaagcagtaggtagtttgaaactctactatgtagaagaatggcgattaagtccagtggaaattcaattaggaacagggctgggagaaatattagcaatgcagataatgttaggagaaatcgagcatcaatcagaattagtgcgggatgccgaaataaaatctctccaatcgcaagtcaatccgcactttttctttaatgcgataaatacaattgtggcagttatgcggtacgacagtgaccaagcacgtgaattactgatccaactcagtacttactttagggcaaatttaacggggattagagaaacaaccattccgttgtatcaagaattcaaacatgttaaagcctatttaatgcttgaacaaacacgttttccaaatcgatttgaaattttgtttcaccagaaggtttcggaaaatgtaatgatacctccatttagcatccaaattattgttgaaaatgcccttaagcatgcctttaatagtcgaaaaaagggcaatatagtttcaattagtgttgaacagattaaacaaagacttaaaattgaaattactgacaatgggcaagggattgataaaagtattattgataaattaggaaaacagacggtaagttctgtaagtgggagtggaacggcattacaaaatcttaatgcgcgcttgatgggtctttatgggaaagatgccgaactaaaaataagcaataatcaaaatggaacccaggtggtaatccaaattccatataaggaacaggtgtaaagatagtgaagatattaattgttgatgatgagcccctagctcgaagtgaacttgattttttattgaggaataatccgttagtagatagcgttagtgaagcagaaggagtcactgaagctaaacaaaaattaatgacggatcaaccggatctaatgtttttagatattagacttgatgacggaaatgggatgtcatttgcaaaattcttgaaaaaggaagaaaaactacgtccatatattgtttttgccacggcttacgatcaatatgctttagatgcatttgacgttaatgctacagattacatattaaaaccctttgaaaaagatcgtattgatgaaacgcttaaacgagttgatagaattttaaaaaagccagaggcattagttaatagtgatatgtgtaaaaatccgcgactttcggttacagttgatgaaagaacgataattattaaaaagagcgatattctttatttggaagcccaaaatgggaatgtactaatttataccaaaaatttaccattaatcacaagcaaacaaacgttaattaaccttgaaaagcagttagatccagaacaatttctacgagtacatagaagttttctagtaaatttagatatgattttggagtttcaacccagctttaatcatacttatgaattaacattaataaatggaaccaagattacggttagtagatcatatgttgctaaaactaaaaaagtgttaggaattggatgatctaatatttataaattgtagaataagttcatacctattcttagaaattctcaactcaatcgttgaggattttttaattaaaaaccaaggtaactaacacgaactgtatggcattttgaaacaaaaaatggtcacttcatgtgaaagcgctaacataaatgagctaatagcttaaaataaggttgtgataaacagtattagatccataaaggtagggaggaagctaaaatgaaaaaagatgggaagaaagaaacaccaatccttattcaaatgggaatatttatggcaattttatttgtagcacaattactatcgcagttatttccgcctagttttgcagttccgacacccttaattggaatgattattttatatatactattagcgacgcacattattaagcttgaacaggtagaaaaactgggggattcattgattggtttgattgcttttttgttcgtactatctggaattcagttagcaggaagcttagatttaattaagcgtgaaggcttacaggatgtcattgtgacaatcatttcaaccattattttattagttgtaatcacgtatgtaggatcgtttttcataaaattacatcaaaaaataaataatagaaaagaggatgattaatatgacagcagccttggcaacaccttttacaggtatcttcatatcgcttttggtatatttagtggggatgtggctttttaagattagtaaaggtttcttcctatttacaccgttactggtgggagttgttttaggaatctttattttggcattatgggcgaaagggattggctctgcaaccgtggaagtctataaaaaattctttttaccgggtggtaatatagtattttggtttttaaatccagcgaccattgcttttgctattccactttatcgtcaaaatgatatatttaaaaaatattggatagatgtagtgttaactttatttgtgggtggatttatttcacttttcggcattcatatggtttcaaaactatttggactatcaaaagtctccattgcagcaatgttacctcaagccgctacaacggcggtggcaatgccaatagctaagagcattggaggtgaccctgccgtaacagccatggtttgtatcataaatgctgtgattatttacgctcttgcagaatttcttattaaatttttcaagcttaaagaaatttcaaaagtggggttaggtttaggtctaggtacatctgggcatacagttggttctgctaaggcagtgcagttaggttcaattcaaggagccatggcatctgtttcagtagtaatcgttgcattagcgatggatattttagtaccgatttacgctcgtttattcctttgaaataaaagataaaacaaataggttctttagttgacatgagacatagaatttggtattctaataaacgttgagaaaaagcagaggccaccgcttctcgccttgtaacttaagttgctgggctaaagaacgttgaatggatactaattaattatccaaacaaagcgggtggcgtatgccatccgcttttctgcattctcgctaattttcctggaggtgaagaaccatagcaaacgatataatggtaaatgaaaccattcgggctagagaagtccgcttaattggtgtcaacggtgatcaattgggagttaaaactaaggctgaagcaattagtatggctgaagaagctaacttagacgtcgtagtcgtatccccaaaggctaagccacccgttgccaagattatggattatggaaaatatcgattcgagcaacaaaagaaacaacgtgaagctcgtaaaaagcaaaagactgtcagcattaaagaaattcgtttgagtcctacaattgatacaaatgattttaatactaagcttaaaaacgctactaagttcttgagtaaaggtgataaagttcgtgtttcaattcgttttaagggacgtgccatcactcataaagagattggtcgtaaggtacttgaacgaatggctaaagaaacttcagatgtcgcacgtgttgaggttcatccaaagatggacggcagaagtatgtttcttgtgctatcaccaattgctgataaataatttaaaattctggaggaacagattatgcctaaaatgaagacaaaccgcgctgctgctaagcgttttaagaaaactgctaatggcggtcttaagagtgcaaatgcttatacaagtcaccgtttccatggaaagactaagaagcaacgtcgtcaattacgtggtacagacatgatggacagtactaacgtaaagcgttacaagaagttactttcaaacatctagttaagaatttaaatttagaacaaatgaccttcgggtgatttaaggaggaatttattatgccacgagtaaaaggtggaacagttacacgtcgccgtcgtaaacgcgttttaaaacttgctaagggttatcgcggtgcaaaacatattcaatttaaggttgctaaagaccaagttatgaagtctggtctatatgcattccgtgaccgtcgtaatcgtaagggcgaattccgtcgtctttggattgcacgtatcaatgctgctgctagaatgaatggtttaagctacagcaaattaatgcatggtctaaaagaagctggaatcgatatgaaccgtaagatgcttgctgatcttgcagttaacgatgctgatgcattcaaggctttagccgaagaagcaaagaaagctctttaatctattagattaaatgaattaataaataaaaaggattggaacaaaacaatgagttttggaaccaatcctttttatttattttctgaactttaattaaacttcaacgatatatttccctctcggatgatgcgtttgaagagcatgaaaagctttttgaatttcagctacatcgaaatttaagatttcggcaatcgggacggttatttcttgacttgcaacttttttaacaagatattctaaagcggcttggttcattttgtaatctgtgttgtaaaaatcaactaatcttgatgggtcagttttgaaggtgtcaatcccagttgtagaaatcaataaaccagatggagcaaggtgggctaagtaaaggtcggccagctcattttgtggcgcaacgttaataattacgtcataaagacctagttgctcaattgtttttggagcatcgtaaaaaacaacttgattaaaatctgcagtatcgaattgttcagtatacttggagttaattacaacggaaacttgcttatttaaactatttaaaatttgatacaagttagttcctaccgctccagaggcaccaataatgagcacttttgaaaacgaaacgtcttttaatgctccaaaaacgatatcatacgcagtgatacctgcgttgggaagacctgcagccgtccgataactgatttcggcaggaagtttagttgctcgacgataaggaactgaaacatattcgctataacctttgaggttagccaatcccacaattgaatcaccaaggttgaattcggtaatggaggggtctttgtccacgatgatacctgcaacatcactacctggaatggctggcagtgaaattgggcgatacttggcttgagtaccatcaataatttctaaatcatatgggtttagtgcaaaagctttggtttgaacaataaggcgtccactggaaggctctggctttggaacgtctagttcagttaaatctgaaatattaccaaattgattaacaccgattgctttcataatataatcacctcttgtactaaagataatataaagttaagtgaaataaaagatttaagcttgcaagtataggttgctctctttccaaaagagtctactatcgtttataattagacagatagcatttatgggagaagattaatgaatatttttaaaccaacgtggatgattgaaaaaatatataatttatctgcaaaagatttaaaccaaaaaggaattacgactgtcttaaccgatttagataatacgttaattgcctggaataatccggatggaactcccgaattaagacaatggatcgaagatctaaaacaagaaaatattagagtaatcgtagtttctaacaataaccatgctcgcgttaagaaagcagttgaaggctttggacttgaatttgattcaagagctttaaaaccattgactgttggtattaatcgagtggtacgcaaaaataaattggataagaactccaccattatggttggagaccaattaattacggatatggccgctgcaaatttagctggagtgcggggagttttagtgaagccgttaattgaaacggacgcttggaatactaaattcaaccgttttttggaattctttgtaaagcgttctttaaaaaagaagtatccggaattagtttggcataaggagttacaataaatggacgaacaaaatgaattacgttgtattggttgtggagcaattctacaagtgactgataaaaaaacgcctggatatacaccagaatcagccttaaaaaagggattagaatctggccaattatattgtcaaagatgttttagattacgtcactacaatgaaattgctccagtagacattagtgatgatgacttccgaaagttattaagtcagattagtgattccaactcactagttgtgtatgtagttgacatgtttgattttaatggaagtttgattccaggacttcaccgatttattggagacaatccagtattgttggtaggaaataaagaagatgtctttccaaaatcaatcaaacgtcatcgtatgaaagaatggcttagacaacaagcaaaggcaaatggtattttgcctgaagatgtggttattaccagtgctaaaaatgctagttcagtggaagccttatttaatgcggtagaaaaattacgtaaaggtcgggacgtttatgtagtcggagttacaaatgttgggaagtcaactttaattaatagtttgattgctattcgcaatggaattaaagatgtaattactacttcccgttttccgggtactactttagatcgcattgaaattccgttcgatgatcatagtaatttgattgatacacccggaattattcatgccgatcaaatggcacatgtattggctgcggaagatttgaaatatgtctcgccacaaaagacgattaaacctcgtgtattccaactaaacagtcaacaaactctttttgtgggagctttagctcgatttgattacgaacactctgagggctctgtaacggcttattttgataataatcttatggttcatcggactaagttggaaaacgcagataatttttacgaaaaacatgcaggtgaattattgacacctccaactgcagataatttggctaaaatgcctaaattagttgcacatcagtttagtgcagatcaagatagtgatattgtttttgaaggattaggttggatatccgttcctgaaggaagcacgattactgcatgggcaccagagggtatttcagtagtaataagacgatcattaatttaagttgcaaataaaaggagaaacaatggaattaagaggaaaacaaaaaagatatcttagagctcgagcacattcataccgcccagttttttccgtgggtaaaaacggtctaactgaagcatggctcaatcaattggcaggagctttagacaaccatgaattattaaaaattaatatccaacaaaattcagatgcaacaacggctgaagctaaagaatttattgaatctaatacagatattcaagtagttcaaaccattggacgggtactagtgttgtttaaagtttcttcggaagcggataaacgtgaaatttcagatacagttaagaagatatagataaaggtgattaatcttgatagcaacaaaatctaaaacagtttctggagtacaagtagaagtggttgaagagccattaatacaaaagaaaggcaagaaaattggcattctgggagggacgtttaatccgcctcacattgctcatttattaattgctgaacaagtaggaagccagttgggactggataaggtgctatttattccagattttattccaccacatgttgatgagaaaaaaaccattcctgctgagcaccgagttgaaatggtccgcttagctattcaggataacccactgtttgatttagatttaatcgaaattaatcgtggtggttcaagttattcgtacgatacggttaaagaattaaaacaactacatccggaaaatgactattattttattattggtggtgacatggcggactatttaccgacttggcatcggattgacgaattagttaaaatggttcaatttgtgggtgttgatcggccgaaatatcaacgccaagaacaatatccgattatttgggtagatgttcctaagatggacattagttccaccaaaattagaaaaaacgttaagaatgggtgttcaattaggtatcaagtgcccgaaagtgtcgaaaagtatataaaggagcaccgtttatatgagcaataatgaagaattaatttatcaaaaaaactacgtgccttttacgcgagcagaattaatcgacgctgtttctaaaagtattaccggaagtcgattcgaacatgttctacgagttgaaaagaaggcgattgaattagcacaaaaatatgatgctgacgtggagaaagccagtattaccggtttactacacgattatgccaagcaacgtagtgatagtgaatttattaaatatattaatgaactagagctcgatccccaattattagattatggtaatgctatttggcatggtgttgttggcgcagaaatcgttaaaaatgaattgaagatttatgatgaagaaattttaaatgcaattcgacgtcataccgtcggggcaccatacatgacattgattgatcaaatagtgttcatggccgattatattgaagatggtcgtgattttgaaggcgtagaacaagcccgtttaattacagaacaaagtttacaaaagggcgttactttccaaatgaagagtacccttgcatacttaatcgctggaaataagccagtttttccagctacgattgaaagttataacgcatggatctcaaaatttaattaaaactaggagaaatagattgaacaatttagaagaattagaattactagtaaaagcagcagatagcaaacgagctgaaaatacaatcgttttaaatgtacgtgaggttagcaccttagcagactactttatgattacaagtgctgattctaaccgccaagtagctgccattgcagatgctattattgaaaaggctaaggaaaaccagatcgaaatccgtcgtattgaaggaaatcgtgctgcagaatggattttgattgacttaggaaatattgttattaatgttttccaaacggatcaaagaaagtactataatctggaaaagctttggtcccaagctgaagcagttgaaacaactgattggattgcagaataatgatatatcaaagctttgcggagttatatgaccaactttttgatgaagatgaataccaaaattggtttgaatatacgcaaaaagaagttgatttaagtcataaaaataattggcttgaattagcttgtggtgcgggaagattggttgttcaactcgcacagcatggacaaatcgtcacaggatttgatttgtcagaagaaatgttagctctagcagaacagcacactagagatgctgaggtggcagcagaactgattcaaggaaatatgttggatttaagtgaattagagcagtttgatgttgtatcatgctacgctgattctttttgctaccttccggatgaagaacaagtgttacagtcgtttagcgaagtgtatgagcacttaaaatctggcggccagtttatctttgacgtgatcactccatatcaaacaggggtgatttacccaggttatatgtttaactatcaagatgaccgccaagcattcatttggtcaagctttgaaggcgaagataaatatcatgtcgaacatgacttaactttttttaccaaagcaaatgatgatgagctatttagacggaccgaagaaactcattttgaacgaacgtatgaactggaaacgtacgttaaacttttagaaaaagctggtttttctaaaatcaaatactatgctgattatggaaaagctgaagtagatgaaaaaacaactcggtggttctttagttgtaggaggtagctgtattgcaagcatgcgcagtgattgcagagtttaatccatttcataatggacatcaatatttgttagagcagacacgcaaggttactaaggcggacttagtgatcgtaattatgagtggcaattttgtacagcggggggaacccgccttgattaataaatgggagagagcacgggttgccattaattgtggtgctgatttagttgtagaaatacctactgaatatgccattgattctgctaaagaatttgcccatgcgggagtagagattgctcaaaaattaggagctagctttttagcttttgggagtgaaaatccagatttggattttgaaaatgagagtaagattctggaccgacaatttgaccagagagccaaaaaatataatcaaaattttgcagctcaattatttgatgatacagccattacgaactcgaacgatattctaggaatcaattatgcgtactggaattctaaatcaaaaagaagcttgcagttaataccattgcaaagggaacaagcagatcaccgagatacggagataaagggctcgattgctagtgcatcggcaattcggagggcagctttagaacaatcagagtactttaacgcggtacctaaggcgtctttaaaggctattagaaatgctaaattaacaagctgggaagatttctggataatgttaaattatcggttattaacttcaacaccccaagaattacgtcatataaagggtgttacagagggtttcgaaaatcgtattttaaatttggttgataaaagtaactcgtttacagagttgatgcagaagttgaagactaaaagatacacttatactagaattcaacgaagtttaacgaatattttacttaatatccaagttactccgtttaatctaactaagacgagattattggcgacaaatcagctcggccggatttttatccgagaagcagcccttggatcagtagtaatgaccaaagtcaccaaagaagattttgaaaataattatgcaattacaaaacgagcagacgatttataccaattagtttctccatatcaatggggaaagggccctattataaaaaagaatgtcaaggaataaacgttgacaatgtggttccacatggtataattgtttctgttgcattggaggttcattatggaatggtattttacagaactgcgtaagcacaaagagccgtttcagttcgatgaaacgatggatttggaacaatctttagtcgaacgctttccagatgtagttattaaatgctcaccaattaattttaaaggaacggtgacaatcgaacgtgattcagttatcattgatgctgagatcagttgtgatttgacagttccttcatcacgatcattgaagcctgtccacatgaatttagactttttcataagtgaaatttatgtagataatcctagtattattgattcttttgcgaaagaagaagtggtaatgctagttgaagatgatgtgattagtgttgataaactaattgaagataatatcgtccttcaagttccaatgcaggttttaacgcctgaagaggaaaaagagggagtcatgccttctggtgcagaatggcaagtgatttctgagatggacgtggaatcggagcatgaaaaacaagttgatccacgccttgctaagttaaagggtttattgaaagataatcctgaatcgtaaggctttaaaaaagcgggaaaccgaattctcttaaaggaggtgctcatagatggctgttccagcaagaagaacatcaaagacacgtaagcgtaatcgtcgtggacacattaagttaactactccaggtttggcaccatgtccaaactgtggtgaattacgagtttcacatcgtgtttgcccaagttgtggttactataacggaaaacaagttattgacgtgaaagctaactaatttgttaaaagaagtaaaaggagcctaggtccttttacttctttttttgtgtttaaaacgattgaatataaattgcttagtgttatatattaattaaatctccttagaggttctcagctttttatacattttttttacttatctgttaaaatataatatattgctacacaaagtttcgagtattttaaaatcaatgtcttgaaacaattgttagatatagaggaggaatcacgatggatcaaccacaaattggtgtagtgggaatggccgtaatgggtaaaaatctcgctttaaacatcgaaagcaggggatatacagttgcgatctacaaccgtactgcctcaaaaactgaaaaagtaatgcaagatcattctgaaaagaaattagttcctgcatattctattgaagaattcgtaaattcactagaaaagcctcgtcgaattatgatgatggttaaggctggtaaaccaactgatgctgttattgctgaattacttcctttacttgacaaaggagatgtcttaatcgacggtggtaacactaactttgaagacactatgcgtcgtaataaagaattggatgaatctggaattaacttcattggtacaggtgtttcaggtggtgaattaggtgcgttacaaggtccttcaatgatgccaggtggacaaaaagaagcttatgacttagttgcaccaatcttcgaacaaatctctgctaaggctaaagacggcgatccatgtgtgacctatattggatctaacggagctggtcattacgttaaaatggttcataacggaattgaatatggtgatgaacaattaatcgatgaaagttacgacctaatgcgtaagttactggatctcccagttaaagaaattgctgatatttttgctgactggaatcaaggtgaacttgacagttatctaatcgatattactgctgatattctaacaagaacggacgatcttggttcagataaaccaatcgttgatcttattatggataaaggtggcaataaaggaacaggtaagtggagttcacaaaatgcacttgaattaggggttccacaatcgctcatcactgaatctgtatatgctcgttatatttccatgcttaaggacgaacgtgtcgcagcaagtaaagtgcttgcaggtccagaaaagaaaattgacgttgacaaggatgaagtcatcgaaaaaattcgtcgcgcactatacttcagtaagattatgagttacgctcaaggatttgaacaaatgcgtgtagcttctgaaaattatgactggaacttgaattttggtgaaattgccaagatctggcgtgctggatgtatcatccgtgctcaattccttcaaaatattacagatgctttcgataagaatcctgaactaaataaccttttgatggattcatacttccaagaaattgctgctaagtatcaagaagccgttcgtgacgtagttgcacttgctgttaaagctggaattccagttcccgcactatcagcagcggtagcatactatgattcatatcgttcagctgttttaccagcaaatcttcttcaagcacaacgtgattactttggtgctcacacctacgaacgtgttgatcgcgaaggtatttaccattttccatggtatgaagaacaataaaaattagtttaaatagaaaagcgataaccgttacggctaccgctttttttatatggattattaaggatatcactttgagactaggtcaaattaagtgagccacttaagtagaggctaggcttttcaccaatatagtgcaacccaaaacgcaagcactagatggaaaaatagttgcttagaatcgaaaaacttttaaaataacaaaactgatgtgaaataagttaagatactataattaaattattacgtttcaaagtcaaatcaaataatctaacaatcttatttatattggattagaaaggaatggaagcctagggaagctatttgactcccttttgtttgcaacataatattggaagcgctaggcaaagcaaccggataatgttagaatttactacagtagggttaaaataatttaattttggggtaaaaaaatgagtcgtattttgataatcgaagatgaaaaaagtcttgcacgttttgttcaacttgaattacagcatgaaggatatgaagttgaagttcaatctaacggacgcacaggtttagaagcagcattatcagaagattttgatgctatcttacttgatttaatgttgccagaaattaatggaattgaagtatgtaggcgtattagaagagaaaaaataactcctattattatgatgacagctcgcgattcaatcattgatcgtgtttcaggtcttgatcacggggcagatgattatattgtaaaaccttttgctattgaagaattacttgctcgtttacgcgcagttcttcgccgagtggatttagaaacacaagattccactttccaccaaacaacggttgaatttcaagatattgttattgaaaaggaaaatcgagttgtacgtcgtaataacgaagtaatcaatttaactaaacgtgaatatgagttgctattgttattaatggaaaatattaacgtggttcagtctcgagaaactttattgaataaggtatggggtgtagacgatggtgtagaaactaacgttgtcgatgtgtacattagatacctccgaaataaaattgatgttaagggacgtcctagctacattcaaaccgtacgtggtactggatatgtaatgaggacctagtatggaaaataaagtaattaaaaaaaagagaatgtcgctaaaatggaaatgggctatcggtactggtgttggagtcctattaatttttgcacttttctctttttttgtttttaaaattgtaacagattcattatatgctgaagaacatcgagatgtggaatcaacagtaacccaagtaagaagtcgtcttcaaaatgcgaatgagattaattataaaactacggatatattcaggcctgatttaaaccaaaaatcggcggttaataataaccaaggtggttttaatgattcattgttagcgagtttaaccaggcgagatttagtagtttcagtttataatttagaaaaagaatcagttttttcgaatcaaagaattaatatgaagactagtctctccgagcgaaagtcaattaaacggagtaaatttcatcataaagatattattgtgggacaagcaccgattattaataaagataatcaagtaatcgggtatgtacgagttgttgatttactggtgaaatataataacagatatcagcgcttgatctggttatttactttaacgtcgcttttaatttttatggtaatctccattttcggttatggattaacggcatacttattaaaaccaatgaatttaattaatcagtcgatgcgtaatttagaggaagatcctcaaaccgatttaagagttcctgaaattgatacaaatgacgagttatcggacttggctcatgaatttaatgatatgattgatcgaatgcaacgctatattgatcaacagagacagtttgttgaagatgtatcacatgaattgcgaacgccagtggcagttgtggaaggtcacctaaagatgcttgaccgttggggaaaggatgatccacaagttttggatgaatcaattaaagcgtccttagaagaaacgcaacgaatgaaaagtttagttagtgaaatgctagatctaacacgagctgatcaaattgagattaattatgccgatgaaaaaacgaacgtcgttcaattagtaaatcaagtattcaatgattttaaggtgattcatccagaatttaatttcgtaatggatgacgatattactggtgaacccattgttcctatatatcggaatcatttagaacaaattctcgtaatcctgcttgataatgccatcaagtactcaaaagatcgcaaagaaattcatatttcaactgctaataccaaaaagaccgttgaaattgctgtacaagattttggtgaggggattgctgaagaaaatctgaaacaggtatttaatcgtttctatcgaatcgacaaagctcgcagtcgagatcaaggtgggaacggtttaggtttatccattgctaagaaattaactgaagaatatcatggaaatatttcgctagaaagttcagttggttcaggttcaatatttagaattaaattaccgattattgaagatcaacagatagaaattagtgaaaaataaaaaatccttggaaaatgagttttactcaaaattttccaaggatttttttggtatttaattttagtcacgatgatgattttgtttacctgcattacgacgaggtttgttattttgtggtttagaaactggtttagttttaggttcactagtaacctctgtggctgtttctgtaatatttttaagatctactggaccagttggttcaacaatcttaggaggattctttttcatttcctcttggatccgtgctttaatttttggacgatagagattaattgcgagtgtttggatacatgcaaaaactccaccaacagcaaagtaaagtcctaatccaccaggggaagaaaaagtgaaaaatagaatcatcaaaggactgacaatcatcatggaacgcatcatttttctttgttctggtgcaacacctaaagtacctaaccagccttgtaataagtaaacaaggaaggaaattgctgccaataaaatacttggcttagccaaattaatacctaggaataatccctgatgtaattcaggtgaatactgaatagctgcgtataatgcggcaaaaacaggaaattggatgataattggaaggcaaccaattccaccagtcatgctaacgttgttatccttatacaaggccatcatttcctgactaatagcggcacgctcttcaggcgttttagctgcttgattacgtgcttgaagtaccttaagctggggctgaataaatgccattttttcttgttgaattgtggctttgcgagattgatttaacatcaatggaagcaaaattaaacgaacaacaaaagtaacaagaataatcgctagcccataacttccaccaagtaagtgtgaaagataattcataaagtgctgagtggggatggctagataatcatagatcggtccatacggattaccgtgtttatcacgttggacacatccactaagaactaatgcgagtcccgagattaaagtaatcgtcgagatacttttaagctttttcataatatacgtacaattcccttctgaatgctagaaatacaagggtaactatacttgattttccgtcttttttcaatgaaatttagtatttaacaataaagtcttgcccttcaaataagggaattgatttaacagttaatttattgactcgtccagatggcgaaggtgaggcttttactccatcaataaactggtctaaaacagcgtctggagcctgcgcctcaatttctacggtaccatcggggttgtttttgacccatccagttactttaagtcgatcagctagtaatttggttgtataacggaatcccacagcttgtacccgtccagaagcgttcatgtgaacagctttcattataatcattcctttcaaaaagatttatattaataattttaacatcgttaccttaatttgttagtatgaaaggtgttaagattaaaagttcggcaagtctgtatatcatttagattgtgataatgatacgattaaataggatagaaacagaatacttacaaatggtaaggagataaggtataattatggaaaagatttcttcaacaaagaatccaaaagtgaaagaatgggtgaaactaaaaaccaataatggtagaaaaaaatttaagaaatttcttttagaaggacgtcatccagtggagacggctttggaacaggcaactgaatatgagtttttaattgtccaagaagactttgatttaggtgagcttgctgaacaagtcgataatgacaaattaattttagtgaccaaagaagttgctaatcatatttcagatactgttcacgatcaaggcatctttttaattggttacattaacgaggaagattggcaatttccagatgatttgtctggaaaatggttagttttggataatgtacaagatcctggaaatattggtacaatggtaagaacggctgatgcggctgggtttacaggagttgtatttggcgatgggacagctgatttctataaccctaagattctaagggctatgcagggtagtcagtatcacttgcagttgaaacgattgaatcttgagaaatggattcgtaattgtaaggatcaaggtagtgtaatttttggttcaattttagatgaaaatgcccgtgactatcgtaaaattgatgttccagaccagttctctttgattatggggaatgaaggcaacggcatgagtgaaagacttattgaaatgacggatatgaatttatatattccaatcaagggttccgcagaatctttgaatgtggcggttgctgctggagtgttaatgtttggtttagctggttaaggttttgttacgttttaaatttggcaattagatttgcttgatttaaaaaagtatgacgctaagatggtagtaacttgagctaaaaaggagctttttaatgaagtcactagattggaaaaatgattctgaatatatggcaattgttggagatttattagagaaaaaagaggttcaaaagttagataactacactcaacatcacaatggaactcgtttggatcactgtattagcgtttcctatgaaagctatttgttagccaaaaaacacaatctagatgctgtttcgacagcacgagctgggttactccatgatttattctattacgattggagaacaactaagtttactttgggttctcacgcctttatccatcctcgggttgctttacgtaatgcggaaaagctcacggtcttgaatgataaagaaaaagatattatattaaaacatatgtggggagccactatcgcgcgacctaaatattttgaaagcagtattgtgtcatttgtagatgacgaacaagctattactgaatattttgatcatgttcgcaaggaatttaagatgaaactcatgaaatataaagagaaaattattaagtttatctagtaaaagaggtttttataatgcagagtacacaactaaaagaacaaactgattttgaactttgtccaaagtttgaaaagatgtttgatatattaggaaaaaaatggaatggacttattttagaagtgcttatgaatgctggtccacagcgttttaaagacattgcgcatagtgttacgaaatgtagtgaccgtgtacttgtagagcgtttgaaaagcttagaggaagctgggctagtggaacgatgtacttatgaggattcttccttaattgagtatcgattaacagaacaaggtgaaaatctacgtccggtgcttgacgccgctcataaatttgctgattgctggttttaattaggtattgacctaatgcgtttttttggttaaagtagctaagagaataaaagctcgaagagtagtagctgatttaaattatcagacagagaaggaatcgttaggttgagagattccgatgatggtttcagtgaattcgcttcgatttaaaaatgggcaggccacccgtatctggctgaccaagtgtgcattgagttgcaaacaagggtggtaccgcgttaaaaaacgtccctttctaggaggggcgtttttttatttggagaaaggtggaaagatcatgagtttacaagagaagttaaaagaacttgaagaaaaaggtcttcaagaaattagcgttgctaatgaattatcaaaattaaatgaagtacgggtcaattttttaggtaaaaaaggtccgattactgaggtcctccgagggatgcgtgatttaagtaaagaggaacgtcctaaggtcggtgaatttgctaataaagtacgtgataacctaacatctaaattggaagaacgtaaagaagaattagcacaggcagccttgaataaaaaattagctgaagaggctgtagatgttactttgccagggacaccgatgaagcaaggccaaccgcatgttattcagcaaattattgataacttggaagatttattccttgggatgggttaccaagttgttgaaggaccagaagttgaactcgaccgctataactttgaaatgctaaatctgcctaaagatcatccggctcgtgatatgcaagatacattttacatcacggacgaagttttgatgcgctctcaaacttctccagttcaagctcgaacaatggaaaaacatgacttttcaaagggaccattaaaaatgatctcaccaggggtagtttaccgtcgcgatactgatgatgctactcattcacaccaattccatcaaattgaaggattagtgattgataagaacattacgatgggtgatttgaaaggtactttagtaactttggctaaggaactttttggtgatcgttttgaagtacgcttgcgtccaagttattttccatttacagaaccttctgttgaagcagacgttacttgctttaattgtatgggaaaaggttgttcagtatgtaagtcaaccggttggatagaagtattaggggctggaatggttcatcctaatgttttgaaaatggctggtgtggacacggacgtttacggtggttttgcctttggattaggacctgatcgttttgcaatgttacgttatggtgttgatgatattcgtaatttctacctaaatgatgttagattcctatcccaattcaataagcgaggttaataaaaaatgaaactttcatacaagtggttatctaaatatttagaactaaacttagaacctaaagacttggctgaaaagattgaacgtacagctgttgaagttgattcagttacaagattagattataaattaaagaaaattgttgtgggtcataccctagaagtgactgaacatcctgattcagatcatttgcacatttgccaagttgatgttggtgaagaagaaccaattcaaattgtttgtggtgcacctaatattgctgcagaccaagatgttattgttgctctccacggttcaagaatcaaagacaacgtcaaaattaagcgtagcaaaatgcgtggagttccatctaatgggatgatttgtgctctgcaagaaattggttacccagacaatgtggtacctaaagactatgcagatggaatttacgtattcccagctgacagccatgttaaaccaggtgattctgtaatggaagctttaggaatggatgacgatgtgattgatacatccgtaacacctaatcgtggtgatatgttcagtatgaacggtaatgcacacgaaattgccgctattctagatcaaaaggctaattttgaagttttgaaggtccaagacgaacaaaaatcagctgatactttagccgatcaaataaaagttgaaatcgatgagcaagatgttgccccagtttacaagttgatggccattgaaaacgtgaaaattgcgcctagtccattctggctacaaacgacattgatgaaggcgggaattcgtcctattaataatgtagtggatgttactaattacattatgttgaaatatggacaacctcttcatgcctatgatttggaccaacttaaaggtcaaacaatttcagttgctccagcgggtgaaaatgttaaatttactactttagatgatgaaaaacgtgatttgcgtccagaagaccttgtaatcacagctgatgggaccccgattgcaatggctggtgtgatgggtggaatggctacagaagttagtgatcaaactcaaaatattgttattgaagcagcaatttttgacccaattaaagtccgtaaaactgctcgttatcataatctacatagcgaagctgcaatgcgttttgaacgtggtattgactatagttcacttgatgatgcattaaacgaagcagccagcttagtagctgattttggtcaagggaaagtaatgagcggggtagttgttggcaatgatactaaacttaatcctgaatcaattacaatcgctttagctcgtattaacaaaattttaggtacgtcacttactagtgaagaagtcgtagctatttttgatcgacttggatttagtacagaattagatgctacaaagcagaccttcaaggtaactgttcccgttcgtcgttgggacattcatattgaagctgacttgctagaggaagttgctcgaatctttggttacgacaacttaccagtgacattaccaactggtgatccaactattggacaacttactactgaacagaaattgatgcgggcctcaagaacagttatggaaggcttagggcttactcaagccatgagttatggacttacaaccattgccaagagtcaacaatttgtgaagggtgatcacgaactagtgaaggtcgattggccaatgacaaaggaccgagaagccttaagaatgaatctaattagtggattacttgatgatattgcttacaataaggcacgttcagtggaaaatgttgctctttatgaacaagggcgagttttctatggaaatggacaagcacaaccagaagaaattgaacatattgcaggagcaattacaggttcaatgcaggctaagtcttggaatgaaaaagaaaagccagtaactttctttgatgttaagggaattgtagaacaataccttaagaatgttgccgttgctggagaagtaagttatgttgcagaccatgatcgtcaggggatgcatccgggacgcactgctgatgttttgcttgatggagatgtaattggttttattggtcaaattcatccaaccactgcagaagagtttaagattaaggaaacttatgtttttgaattgaatttaacaaaaattattcatgccgaaaagaagttacaacattatgacgtaatttctaaatatcctgcaattacacgagacattgctattttagttaataaggaagtttctaatacagaagttctaaacgttattaatgaaactaagcaaaagaacttgataaaagttgaattgtttgatgtttatgaaggtaagaaccttgaaaaagggatgaagtccttggcatatcaatttacttatcaagatacaaatgatactttgcaagaagatgctatcaatgatgaattttctaaggtaattaaaaacttggaagagaaattaaatgtaaccgttagataaccgtattaaatctatgttactttaatgcgaagttaaagatagttattgtataattaccattattgtaaatgataggagaaatgatcttggataataacaatgattcgaatcaaagacatagtcgtgtacagagtaactataaacgacaaaaaaacggtcacaacattattaaatgggtgattggtatcttagttgctgttgttttaatcactacgtttatgggataccgctattacagcacttccctacaacctttagacgcgaagagcaataaacaaattgaaattaatattccggttggaacaacttcacgaggagtgggctcgattctagaggataaacatgtcgttaagagtggtgcagtattcaattactacactaagtctaagaaaatcaataacttccaagcaggttattatgttttaaaaccatcgatgactttaaaacaaatcgctaaaaaacttgaaaagggtggagcagcagagccaattgccttgaacggtccacgcgtattaatcaaggaaggcgaaaatattgatcagattgctaattcgatgaaatcttcgaagtactttaagaagtccgatttcttgaaattaatgaaagatgaggactttataaagagtctagctaagcaatatcctaaattactgggatcggcgatgaaggctcaaaacgtgcgctatcgattagaagggtacttattcccagctagttatgcaattgataaaaataccaaactaaaagatgtcattacgcaaatggttgctaaagaggatgctgttttacaaccttattattctaagattaaatcagatggtttaaccgttcaggaaactttgagtgtagcgtcactagttgaaatggaaggtagtaaatcttgcgatcgctctaagattgcaggggtcttcttaaatcgtatcaagcaaggtgaaacattaggatctgatgtttcaacacgttatgcagttaaaaaatccgcaacagaagacttaactcaatccgatttagcaagtactaacccatataacactcgggtgaatactggatttatgccaggaccagttgataatcctggtgaagattctattctatccgtggttaatgctgatactaaagacggatatctattcttctttgcagttacaaaaaatgtatctggttcaaaacataaagttggagacgtcttgttctacaaagacattacttcatttaacgaagcagttgcgaagtacaatccagaaggtaaatagtgaggaattaagcttatgagtacaaagaacagcccaataattattggggtaaccgggggatccggtagtggaaaaacaactgttagtcaaaaaattcttgaagaattacatggtcattcgatttctatcattcaacaagattcgtattacaaagatcaagctgaaaaaacgatggaagagcgccgggcggttaattacgaccatccactggcctttgatgccgaccttttatatgaacatttaaaaatgttgaaaaacaaccaaaaaatcgaagttcctatttatgattataaaatttcgacgcgaagttcagaagttattgaacaagacccaaccgacgtgattatccttgaggggattttaatcctagcagatgagcgaattcgtgatatgttagacattaaggtttacgttgatactgatgatgatattagaattattcgtcgtattcgtcgcgatatggaacaacgtgcacgaacattagattcaatcattaatcaatatttaacgggtgttaaacccatgtaccaccaatttattgagccaaccaagcgctatgctgatgtgattgttcctgaaggtggaaaaaacagtgtggcgattgatttattggttacaaaagttcgcgatattctatcagaagatgggcgcgatgagagttttaataaataattttgaggtgtaaaaatggcagatgaaaaaacttatccaatgactttggatggaaaagctaagttagaagaagaactagaaactttaaaaacaaagactcgtccacaagttatcgaacgtattaaaatcgctagaagctttggcgatctatctgaaaattcagaatatgaatcagctaaagatgagcaaagcatggtagaaagccgaatcaatacggtcgaacatatgctccactatgcacaaatcattgataatgatgatattgctggtgatgaagtttctttaggccgagtggttgaatttaaagagcttcctgatgaagaaccagaagaatatacgatcgttggggctgcagaagccgaccctatgactggtaaaatttcaaacgattcaccaattgctaaagcacttttaggtaaaaaagttggcgatgaagtttcaatcgctactcccggtggagatatgaaagttaaaatcctaaccgttaaaaatgcttaaaaactaatcatattaaaaaagcttttcacttcttatgagtgaaaagctttttttgttggagcaagacgagcattagaaaaccaattatggtaatagacatacctagcataaagaatggtggtgtataagtaaacttgatttgatgtttgccagaagttaattttacgttgcttcctaagaagtaattaccgactttagaagtaggaatcgttttaccatcaattttaatgtgccatcccgaactgtaagggatggaagtgaataagtagggtttatcagaattaacgtttaaattgcctgtgactacgttcccagcgttttttacctgcgttagactatttgtcttagcagcttggtaatcttgcttaaatgtgccgtaatgaagctcagcgacactaaaatcagataaaagtaaactttgcttctttaaaacaatttgaatacgaacttttttgcctttcatctgatctgcaatcgataaaacaattggttggtcataatcaaggtcttcagtaattcgttggttgttaacgaagatatccgcattatcatgtgaaagttgtgatccggcggtaatataaattggattattattttttggctcatattcaaaagttaccgtggcagccttattaagtttctgtttagttaacagaccatttttaatattaggcgtggaagtaacatttgaaaagtaaatttgggcctggttagtaatgtctgtaaataaattttgagaatgattactgatttttttgagtaaattagattgatattgcaaaggatttccaatttttttagtattacttaccggatgagtagtagtaagacctaatggaagggcatattgatttaagtagttatcagcatatttagtgttaccaatctgatgatacctttttaaaacatcgtgccgaacacttttagttgaaaaaggattatggtcagtttcgttatttacaaatgaccaatacttgaagttcaggagggcatcagagatcaaggttccgttcatataggtcacatttccggaagttgtaggttggcccagagcactcatcatatcaagcatattagtttctaggttagagttaaaacttgatccactattgaaatctaattgaattggatcatttttagtcctagagtaatttgtaccaatcctcgaaaaatgatgaccttggtctttaatctggtcgattgcattgcgagctgctgagctatattgagcaaattcggtttggctaacataacttatacgattcaacgaccagatagcattgacagataaatctagggccataaaacaaattaaaattggcgtgagccccggattaaagtctttagcttggaagccaacccaaaagacaagcgctgcaataaagataataactccaaattgaatttgattctcggtcataaagtcgctaatttttggtaaatttttagttgatatataagcaacaagactaatgagtgctaaaccagcgatgatgggttttaaaagtgcttcttggatgggatgtaatagtccttcaaaagctaaaataagaacccagaaactaaaaatgaaactaaaacgatatgcataccaccatggaaattgcatggcatgccagaataagtttaatggggtgaaacagaaagaaagtaagaaaaaagcagttattaatagagctccaagtcgtctttttaaaccaatatttttattgaaaaagtaggcgacaaaagccgttaacacaaacattcccacgtaaatatttggtagaccatcagacatttgcttaaagctgaatgtccctggcattaatttagttaacattttaagtggtgtgtaagcaaaagaccatttaattgagttttctgtatactgtgctttaccatggaggagagcccataatgtcggcatccaagcaatggcggaaaaaactagaacgtaaatccaagattgaacatagtgaaaaatctttttccatgataacggcgaagctcgccataaaaagtaaattaaggtgaaaataccaatcatataagcaaagtaataatttataatgaccattaagctcatcgtcgttacaaaaattttaatttgattttgatcaattagagcatccaaaccaagaataattaagggtaataagatgggagcatctagccaaaaaaggttaagttgattggcgatggaaaaagccatcaaactataggtagtagcaaaaccaacaacactagctcgcggagtggtgattttatttttttgagcaagatgctgcaagtaaatagcagatgttagtccagctaaagcgtattttagtacagttattactaggattccggaagtgatactctcttttttaaaaaacaaaagcagcaaattggttggactgaaaagataataagcccaagtaccaaacatatctccacctaaaccattggaaaaagaatagaaaaactgaccaggatgactgataagtgtactgcggaaatattcatagaacgcgacatattgctgtcccatatcgacagttaatagactagatgttccaaatggagcaaatccgcgataaacgaagtatgctagcataatgcaagcagggatacatccacttaaaattaaattctgatgtttcttaataaaatccattaaaatcccaacctttaaattgataataataggatagcacaaaacatgcttaagactttgttaatactattagtacaccgatatattttctggtagaatgaacgaagtgatctaaaaggagcaacataaataatgaaaaatcctaaaaaaattaggcgaccaaaaagtgaattaccatttcgattgaatttgatcttttttgttgtttttgcgttattactactgttagttggacaattagggtatttacaaattttgtatggctcgaagttgcaagcagtcgtaaatcgaactgataacaccgttgaaaccaataatgttcagcggggggtgatttacgattctactggaaaggttttagtaggaaatactgcgcatcaggctatttcgtataccaagggtgccaacgtaatggctcaagacatgttcaatattgctaatacacttggaaaatatcttgaagccaatgatacagagttgagtcgaacagatattgcgaattacttgctggcagattctaaaaatagtaaatactacgaaaagaaaattactaatcgtgaaaatttgagtagtaaggcagttcaggaaaaagaaattgactatatcaaaaattcggatattaagttaagttcaaaagaagaaaatgctgctcgaatttttaaaattatgaatggagcttaccaactttctacggtttatattaaggaaacggatgtttctagtaaggagctatctgagattggtgagcacctttctgagatgcctggggtcaaaatttcaacaagttggactcgtagctatccagaggggaatgacattaagtccctagcaggaacggtaagtagttccaaaactggtctacctagtgatgaggttaacactttattagctgaaggttatgctcgtaatgatagcgtgggacaaagttatctcgaaaaacagtatgaatcagttttaaagggaaccaaatcgcagactgccattcaagttagctcgggaggacagattgttaagaaagttcaacaatatgctggtaaaaaaggtgataatcttgttttaacgattaactccaagttccaagaagaagtccaaaaaattatgaaagaggcctcaaaaaacgctggtggacaatcaactggtggctatgcagtggtaatgaatcctaaaacaggagcagtgattgcgcttgctggtgctgaccgaaatccttcaacaggtaagatgacagataatgtcttaggaacaattaatgaaccaattgtaatgggttccgtggttaagggtgcaacaatttctggagctttgatggacggggttattactcccagcaataataccttgattgatgaaccaattaaggtggctggaacaggatcaaagagttcttggtttaatagtactggtagtgcaaatatgtcagttaacgcttcgagagcgttagaagtttcttctaactcatatatgatgcaattagccatgaaagaaggagggtttaagtactcctcaggggcatccttgtcagggatgaatcctaatgtctttaacaaattgcgtggatattttgaacaatttggtctaggtactaaaacaggcattgaccttcctggtgaatcttctgggtttaaaggacctactggctctgctaatattggtaaagcgctcgatttatcttttggtaattatgatgcttatacaaccattcaagttgcgcaatacatgtcgaccattgcaaatggtggttatcgtgttgctccacatgtggttgaacaaattagaagtagtaaacaaaatggaaaaatgggagcagtccaaaagaccgtttcaccaactgttttaaatcaagttgatatgacttctgcacagagaaaattagttacagatgggttatatgacgtggttcatggaagtaataaatataagaccggtgggccactagctggtatttctcccggaatttctgctaaaactggtacagctcagacgacaaccaatgggaaaacaacagtaacgttgtcattagcttcttatgctccatctaatgatcctcaagtagttgtagcgctagctctgccaggattaagtacaaatgctgaatcggataatatgacggctgctaagaagatctatgcggcatattggaaatatgtccaatccaaatcaacccttactaatccaactaaagcaacctctgaaaccgctgctcagaacttgaattccaattaatcgcaattggttctggaaaaattttcagaatagtggtaacatgtacaatgctagtggattttcgaattcaaatatatatattaatggaggtcattccaatgcgtgtacacattactttagaatgtactgaatgccataaccgtcaatacttatcaaacaagaacaaacgtaacaatccggatcgtttggaactaaacaagtattgccctcgtgaacgcaaagttacattacacaaggaaacaaaataatcgtaattaaggctggaagactgcaatttgctgtcgcttctagctttttttatatatttaaatgtaactatgggggataaaatgaataaaaatatctttaggcaaactcaaattaaacgcttaaatcaaattgatataacgtctaaaagagctaaagaggcgttaattttagaaagttttttcgatcaacatgaagtaaaaaatgctcgaaaattagcgataactatgagtcacggctttgagctagacaccgcacccattattcaacggctaatggaaaatggtaaatgtgtctatgtcccacggaccttgccagaacgacagatggagttcgtcgaatataatttaaatacacccatgcaaccaaagttccaaggaattttagaaccagtaggggggaacgtggttcgtcccgaagcattggatctaataattgtccctggtctagcttatgaagtttcgaatggttatcggttgggatttgggggaggatattacgatcgttacttgaaaaaaacgccagcctcgaaaatagttttagctttttcagaacaaatttattcagaccctcagtgggatgtagaaccctttgatgtaccattagaaaaaattattacagaagaaggggttcaatttgaacgttagatgattcggtttgaaaagggaggttcttaatgagtgatcaaaaacagcttttaaagcgcctgtacgaaggcccattcgttacacaaacaatcgtgggaattaatattttagtttttctttggttgacgctaatcggcggaagcacgaatatttcagtcctagttacccacggtgctttggtaccggtgctggtacaaaacggtcagggactgtggacaatatttacatcgatgtttattcatattggatttgaacatatcttgtttaatatgattgcgttatactttattggtaggcttttggaacgaatgattggtcattggaaatttgtattaatatatattttttcgggactttttgctaatttagcaagtttagctttctcaaaccctaatagtatttctgctggtgcaagtggggctatttttgggattatcggtgtatggctgatgatggcagaacagtatcgagagtaccccgcattaatcgatatgggtaaacaaatgctattatttagcgttttgggcttgataagtggactgttgggtactaacatgaatattattgcgcatttaggtggtttagtttctggatttttaatagcgtatgtaatcggattccctaaatttggtaaggttccaacttggaaacatattggtagtgcaattttaatcgttcttatgatgatagcgttttgtaaattagcgtttacatcataacaataatctggtaaattagttgagatggtattatggaaacactttatgatgtgcaacaacttttaaagcaattcggaatatttgtttacgttggaaaacgtaaatgggatattgaattgatgagtattgaattgaaaaatttgtacaaagcaggagtcgtcgataaaccgacttatgttaaagctcagttggttttacgacatgagcatcatattgaagaggttagagataaccaacaaaaataatggagggtttcgaagtaatggaacgtaaattaatcggtgtcgatcttggtggaacaacaattaagtttgctattttaactgaaaatggcgatgttcaacaaaaatggagtgtggaaacaaatgttttagatgaaggttcacacattgttccagacattattgactcaatcaatcatcatcttgatttatataagatgactaaggatcaatttattggaatcgggatgggaacaccgggaactgtaaaccgcgaaaatggtacagtaattggtgctttcaacctgaactggaaagaaactcaatacgttaaggatgcaattgaagatggtacaggaatcaagtttgccattgataacgatgctaatgttgctggtctaggtgaacgttggaagggtgctggagaaaacggcgaagatgtttctttcgttactcttggtaccggtatcggtggcggtttgattgctggtggacaattgcttcatggtttagctggagctgctggtgaaatcggacatgttacggttgatcctgaaggttacctatgtacatgtggtaagcgtggatgtcttgaacaatatgccagtgctacaggtgttgttcatgtagcccgcgacatggcggaagaattttctggcgattcagaacttaaacgtgaaactgatgacggacaagatattacttctaaattagttttcgaccttgcaaagaagggtgacgttttagctcttcgtgttgttgatcgggtctgcagtctcctaggacttgctttaggtaacttggctaatactttaaaccctgaaagcattgttatcggtggcggagtttcagcagctggtgatttcttattagaacgtgtccgtaattattacgaacaatatgcattctcaactgttcgttcttcaacccaattaaaattagctcgcttaggaaatgacgctggtgtaatcggtgccgcttcattagctcgtgtatttgcataaataaaacaaaaattttggagatgagagaaacatggctgttgctgctgcaaaatatacaaccggattttggataaatacaatcgtgatcatccttatcattgcatatctagtttatcaactttacttatactggaaacgtggtaagatttcgactcaattagatgatgatgaatttcgagctggaatgcgtaaagcacaagtgattgatgttagagaaaagaaggaatttgatgcaggtcatattcttggtgctagaaatattccgtattcgcaaatgaaagacagaacccaagaattgcgttctgatttaccggtttatttatacgatcaaggacgtacttttagtggacgtgcagcaatgcttctatccaaaaaaggtttcacccaactctatattttaaaaaatggatatcaacgttggactggaaaaactaaaaagactaaatattaaaaagagattgggttaaaatagaattaacccaacctcttttttatttgtgtagattagccattatgtgcagagtgctgtttacggtgcgcacgacgacgattttcttcggtgcgttcgacttgttcttcaacaggttcaactacgactttatgaaaagcgaagagtgccccagcaattgcaccaagtgttgagattgttccaaatagaaaaccttttacaaatttacccatcttattcagctccttacttatgattaccttaattatgcgctgaattgatttaaaatgccagaaatagatataggagaacgatatgattactcaaattattgcccaccgtggaagtaaaggcgtgcgaccagaaaacacaatagtggcttttaataaagctattgacgaaggcgctgatggaattgagactgatgttcacttgtctaaagatgggaagttagtcattattcatgatgagactgttaataggaccacagatggagaaggccgcatttttgataaaaccttagctgaaattaagaaattagatgcgggagcatatttcagtgaaaagtatgttaacgaacgcattctaacgctccaggaagtagttgatttattaattcaaagaaaatatcatggtatttttaacctagaattgaaaacagataaaattaaatatccaggaattgaacaaaaggtttatgaagttcttaagggtgaagatttcccattccatttggtatattccagttttaatccgaaatcgattagcgtgttacatcaattacaaccagaagttgaagctgctagcttatttaaaattaatacgaaagcggctcgccgattcagtagaagaagaattattcaagagtggcacccaagtatcgcatgggtgcgtagtcatcgatttttcttacctcacgtccaattacggccatggacagtcaattctgaagatgatatcaagtactgctttaaaaagaattttaaggggattatcacggactatccaacaagagctttaaaaattagaaaaaagatgcagggagaataatatggaaaaatttttagcaattgttggtccaactgcagtcggaaaaaccaacctgtcgattgatattgcaaaaaaatttaacggagagatcatttctggggattcgatgcaagtctatcaaaaattagatattggcacggcaaaagttaccatagaggaaatgcaaggaatcccacaccatttgattgataccaagactatccatgatcgcttttcagctgctgattttaaagaaacggctcaaaaattgattagtgaaattagtcagcgagataagctaccaattgtggttggtggaaccggtttttacctacaggctctattaagagatttggagttaggaggtagcaatgaggatcgaaatcaaattgaagcgatccgtgcagagttaaatcaaaaagaaaatgatgaactattatcgatactaaaaacaatcgatttagcaacttacgaaaatattgatcgaaagaaccggcgacgaattattcgagcaattgaagtttttaaagtgtcaggccaaaagatgtcagaccagcaaatgcaaccgacggcggtttatgatgacctactaattggcttaaatacggaacgctctatcttataccaacgtatcaaccatcgggtaaacatgatgttagacgctggacttgaaaatgaagcacgctggttgtttgacgaaactaaggtaccacaagccaacaaggggattggatatcgagagtggcaaggttattttgaaaatgagaagactttatcagaaaccattgagctaatacaaaaggattctagacactatgctaaacgtcaacttacatggtttagaaataagatggatgtaaattggtatgatattatccaaaatccacaagagcaagcaaagatatatcaaaaaattgaaaactggttaggtgttaaaaatgaattggaaagatgattttaaaccggaagtaaaaagaatcattgaagaggttgaaaaacaaattcaaccacgactaagtgagattgatgatcaagtaacttttaatcaacggaaagtattagaagcctttcaaaaggaaagaatttccgaagaaaatttaaatggagcgactggatacggttataacgatatgggaagagacgctctagaccgagtttatgctgatgtttttaagacagaggatgcgttggttcggccacaatttgtttctggaactcacacaattagttcagcctattttggaatgctgcgtcctggagataagttattatacttaacggggatgccttatgatacgattcaagaagtgattggcgtcactggtaaagcaggaatgggttcattgaaagactttaaaattgatttcgattacgttcctttgttagaaaatggaaaagttgattttaaagctgccaagactaagttgacggatcaagttaaagtagtagcaattcaacgttcaagaggttactctagtcgttctagttttactgttgatgaaattaaagtgatggtagatcatgttcgggagattttacccaatgctattatttttgttgataattgctatggtgaattttcagaaatagtggaaccaactgaagtaggcgttgatgtcatggtaggttcattaattaaaaatgctgggggtggaatcgcccatactggtggatacgttgttggaaagcaaaaattaatcgagatgattgctaatcgtttaactaatgttggtgcaggtaaggaagagggagctaccctagaaaatcttcgcagaatgtatcaaggctttttcatggcccctgaggttacgggagcagcaattaaaggcgctatttttgagagcgcaattttagaaaagtgtaatttacaagttgatcctaaatggaatgatccacggacggatttgattcaaacaattaactttggtgaaccagattcaatgattcgatttgctaagcaagtacaaaaaaattcgccaattgattcatatgttgatccagagccatctcaaatggctgggtatgaagataaagttattatggcagcgggtacctttgttcaaggagccagcattgaattttctgctgacggaccaattcgcccaccatatatactgtatttacaaggtggtctaacttattcacacgtaaaaattgcaatcactaaagccgttgaagaaacgttctttaactgatgttagaaaatgtaacatcagctattgacgtagctatcattgactgttaaacttagttcaatattaaaggggttattggtatgagtgaaaaagagcttcgtcgctcgatggctgttttaccgattggtacagttatgaagttaacatctcttactgctcgacagattcgatactatgaagaaaacgagttagtttttccagatcgaagtgaaggaaatcgacgtttgttttcgttgaacgatattgatcgattgcttgagattaaagattttattgcagaaggtttgaatattgctgatatcaagcaacgctttgagcaacgaaaagaagaactgaaacgctccatttcggatactcaaatgcggaaaatcttaagagaagaattacttcaaactggaaggctatcggatgattctggcccagtctttccaattaaacgagtttagtataaaaaaataaagtggggcgttacatacagttatggcaaagaaaaattattcgcaagcagatattcgtcagatggcaaaggatgaaaatgtacgttttctccgattaatgtttacagatctttttggaataattaagaacgttgaagtaccaattagtcaattggacaaactattagataataaattgatgtttgatggttcctcaattgacgggtttgttcggattgaagaaagtgacatgtatttatacccagatctttctacttggatggttttcccatggggaagcgaacatggcaaggtggctcgcattatttgtgaagtatactcaaatgatcgtaaaccattcgtgggtgatccacgtaacaatttaattcgagtactccaagagatgaaggatgcaggatttactgattttaatatcggacctgaacctgagtttttcttgttgaaattagatgaaaatggtaaaccaaccactaatttaaatgataaaggtagttactttgatttagctcctgttgatttaggtgaaaactgccgtcgtgatattgttttggaacttgaaaatatgggctttgatgttgaagcttctcatcatgaagttgctccaggacaacacgaaattgactttaaatacgctgatgctttgaccgctgccgataacattcaaacctttaagttggttgttaagacagttgcccgtaaatataacctgcatgctacatttatgcctaaacctatggatggaatcaatggttcagggatgcatttaaacatgtcacttttcaataaggaaggcaatgctttctatgacgaaaagggtgacttacaactttctcaaaatgcttactggttccttggtggactattgaagcatgctcgtagttatacggccgtatgtaacccaattgttaactcgtacaaacgtttagttcctggatatgaagctccagtatacgttgcttggtcaggttcaaaccgttcaccacttattcgcgttccttcaagtaagggactctcaactcgttttgaagttcgaagcgtcgatccagctgctaacccatacttagcaattgcatcagtattggaagcaggcttagatggcattagaaacaagattgaaccagaagattccgttgatcgtaatatctatcgaatgaacattcaagaacgtaatgaagagcatattacagatctaccttcaacattacacaatgctttgaaggaattccaaaatgatgatgtaatgcgtaaggcattaggagatcacattttccaaagcttcctcgaagctaagaagttagaatgggcttcttaccgtcaagaagtgacacaatgggaacgtgatcaatatctcgaaatgttctagacaaatatctataataagagttataacacggttaatcgtgttgtaactctttttttgtgaagaatgtttaaatttattgtcgaattcctttatttatttgaaatttttttgtaacattagagacagaacgatagaatggagcgatatcatggcagatgaacgtatgaatcacgaagaatccagtcgggatattttaatctcgcaactgaaaaacaaggatcaatacataaacgaattggcggaagcaattgatcagcacaacgatttgcgcatttatcaattgctaggacctttgcgctatcgggatgaaattaacgatgctttcgacttggaatttggagaatatccatttgagttggtaaaggatcaaagacaagaattagcacatttcttgagtgataatttgattgattatttaatcgaaaaatttccatttttctattaccgcgaagttgaaaagggacaatttaaagtcttctttggtaattggtgggatcgccgtgaaatcgggacacttgatgcattgaatgttgaatatacactagacgaagaaaaacttgaaaagcttgaaaaagcattgaatattgatgaagcgggtaaaactttaaactcagaccaaatcaaccaattatcagctaaaaatgttgagttacaaaaagtggttaccgctcaaactgaacttgaagataagcaaaaagaattgatggaacgtcaaaacaacttgtcagataagggcggtttatttgaatcaaataagattaaagaagaacgccaacaaattaaggaagaacttgctaagatcgctgaagaagaagaacaagcggctgaggctcctgaacaaattcgtaataatcaaaagcaaattttagttctttccaaggaagataccacgctcagttttgaaattgaggctttaaagaagagtttcacgagttatagtgagttccgtgaaactgccgaccaactgtataaaaattatctcagtagcctattagacgaagggcaggtaaagtctaatggataacacaatcaatgaagataaaaaaagagcaacattatccgacaagttgctgaaagtacaatctgatttggatgctggattaagcaaaggtcgtagtttcgcagaattatttcgtactttaacaactacagatgataatgtcgagttattggatgctgcaaaaaaactttatgcgttcgtagttgatagcgatgcagttatttttcctcagaaatttgaagctagtgactattatttaatttttatgactcgcttaattgaattaagtggtttaaaaactaaactgggtctggaagttgaacaagaaaataattaccaaaaacttttccatacttggacagggactagccaaaagttccgttttaaaatggcaaataatcaggctgaatatgttgatcaggcaacgcaacaaactatttttcatttgagtttagatgaacggaaaatgagctttaatactgatacaattaataatttttattttctaaatcagcaagatgacgaagatagcttggttgacgagattaagttatttactaaatttggccaaattttagaagaagtatacaattttgaagttgactttaatatgtttgatgctcgtaataataaagtttatgagtttgatcaaactagcttaaatacagatattattgatgaactttttgtggatgctgctaaaaatggttttactttgctaaatgctgagaaactattgggagcatacctaaaattagataatcatgtagttttctcgatttttcaagagataccagcaaccgaccaatgggctattcaagttaatgataaaagtgaagaaaaatcattgtttgatatcttgaagcagtacgatttcttgaacgattggtatgttagaaatattgcagatttaaaattaaaaatgttattttaggtgattaagatggattgggcaaaaatgttgcaaacatcggttgcgttagaccgtgatattagatttaagcataacttggccaatagtatgcaagaccggattcaagaagcttatatatctttggatgttgaacttgcagaaatagctaatgctgcagaatggttcaaggtatggaaaactcatcgtggcaaacgcgacggagagttatcggtccatcagacggttttgaatgagtttgtggatgctactgatttttttctattgatggctaatttaaaccaatggaatcatttgatagtaattgaagatgaagaaattgataagtataaggcggattctcgtacgcccgacttatctctaatgtatttaaatattaagaaaatgttgttttcggcgtatgcgtataatcgaagcacagattatgtacatgcttggcatctgtttatgaagtttggtattaaaggcttaggatttactcctgaagaaattgaggaaagcttttttgctaaaaataaggttaattacgagcgtcaagaaaataattactaataggaaataacagaaaactcaaaatctgctctggttttgggttttcttttaattaataaaaccgtaaaatacggtcaataattgaagatttgtagttaatgcctctatttctaaaatgggattctttcaatgaatgaaaaaggtatagacaattaaagaagatggtttatgggctagtaaattgcaaagcaaagtttaagttaagatcataatgttttactatggctgcgaggtgtgaaataattgatacagaagcttactgttcacttctaaaatttaagttagctaaggaagtgataatgaatggcgtatactgatatttatggatttaaacacgaaaatgcaacagttattagtaaacaagacgaatttcatcgcgtttttattatcgaagatgaaaaacatcgtcgttttgaatgcttaaaagagcatcctgaggctacccataaagggccgtcgcattggaaactagccaagcaagatacaccgccagataattactgggatgtgttcgactcggatggaaaataattaatatagataaaagaagctaaatcgttaaaaatcggtttagcttcttttagtttaatggagaaattctagcgctctaaagataatcccataagatgattttttgtttgaacgtatatacatattttgtttttcgaaattaattaaattggccattaagataagctttggtggttatgatgataaggcctaatataattaaaataacacttaaccaatgcattgaacggttacgatattcatagtgagtaaagatgaacccatatcgaattttggtgttaaatacagtaatcaagattcctagcatgaaaataaaaacaccaattaaaataatgacatccatttctagcaatgctcctaaacttttgacttaatctagtaattatatgttagattttattcgattttttagtcgaagtcacattaattgcttagtataaagatttaaaaataaaaatcacccaatctaattaaagattgagtgatttttatgttgcttagtgagcgtttggtgagcgctcttgttttaaaagcctataccatagggcttctaagctagattaatatgattcgggagagattcgaactctcgaccgtccgcttagaaggcggatgctctatccagctgagctaccgaaccgtacttaaacagtatatttaaaaatgaccgttctgtcaatggaattattacaaatagagggatgaaaaaagtggatataaatcgcaattaacaaagcaatttcaacattataaattaaagaaattaaacggggttaaacgctttaattaatttgaattattaggtattattaaattagaagttaacgaatagagggtggcttaaatgaaaaaaattatctcggttttactttcgctgatggtagtaacattatttatgagtgcgtgcacccataataatgtttatggcacggtagtggtgtctcctgaaaaatacaagcaaatttcagcagataagaagttgattgagaagactatcagtggtctagaaaagtttaattctgaaaacccagaaacagaaaaatcagtgatgagatctctagatgctttgattaaaaagggccaaaggaaaatgaacgatagtgatcgagtaaaatttgaggcacttttaggcgatcataaaaatggagttaaagggatcgttaagaaagcttacactcatcaacggggttttgatgatgacttgagtggtaggattaggtcaaatatgttgaaatcaattaaattaatgacgcatggaattactaaaaacgaaaatgatcgaaaaaaaatatataaacaagttttagaagatactaaagcagataaaaacctatataaaattggcggaaatgaataaaaaatgaggacaacgaagcaacattatttatatgatgcttcgttgttttttgttgcttatatttatgttaatatacagttcttaattattagaatattactaaatgcggatacatgggtatttttgcacatatttcaataaaagcataaattttaatatattttaagaaataaaatgcgcgaaaatcgttcatttgtagaggtttatacggtatcatggacattaagggtataatccgcatgttattcaaaaagttagtttattgtaaaaaagtttccattggattaaactctaaaacgtgaatcaagcgtttataaatgtgaggtgctgaatatgaaggaagatcctagaattattaagacattaagtaaattgcaaaaggcttttgtgatgttattgaagacatatgacgctggagatattaatgttaggcaaattagtgatgaagctggggtaacccgtggagctttttattcacatttttctgacaaaaaagaatttgttaattttacgattaacgaactagtgggctctttatttaattcatcattaaaggattcagttggatttgtcgatgaggttaatcacaaaaatactcatggaaccaatgtactatcagtctccaacttttttgataaagttgcagcagattatcaaacgtatacgattgtattagatacggaaagattgcctcagtttaccgaggtgcttaaagaacgtttgaattcagaaattaaaacttttgctgaatattacggcaaaaaggtaaagcatgatggttttcccattgaagttttaagctcatactatgtaaatggtctaattggaatgattagaatgtggcttgatgaaggaatggtatacacttcacattatatggcaaatgcggccaagaaaattttaggaacaaaaattcaaattgatagtcaaaatattgacctttccgattttttcgtagattaacattgactattatttaaatctacagtatagtattaacgttggtgtggtctccacgctacaaccgcacaaagtgagttttaaagcatagcacttactttggcgagtcttagaattaaggaggtgcacgttgtgtacgcaattattaaaactggtggtaaacaacttaaagttgaagaaggtcaatcagtattcgttgaaaagttaaacgtcgctgaaggcgaaaaagttacttttgatcaagttctttttgtaggtggcgaatctacaaaggttggttctcctgttgttgaaggtgcttcagttgctggaactgttgaaaaacaaggtaagcaaaagaagattactactttcaagtacaaggctaagaagaaccaacatacaaagactggtcatcgtcaaccatatacaaaagttatgattgattcaatcaacgcttaatttgattgaaggtgatgtggcatgatacagacttgtttttatagagataaagatcgaatcagtggttttaagataactggtcatgctgattctggtgagtatggacgtgatatcgtatgtgcggctgtgtcagtcttatcgataaatacagttaacagtatcgagcaaatcactaagataatgccactagttgattcagacgatgaaaatggtggatttttatctgttaatgttcctgaaagcagtgatgttgattcgaatcgaatggctcaagttttacttgaggcacttgagattggattaagggatattagtaagtcatacaaagaatatctagtaatgaattaatttattcggaggtgtaattaaccatggaaatgaatctacaattcttctctcatcataaggggggcggttccacttctaacggccgtgactcagctggtcgtcgtcttggaacaaagcgtgctgacggacaagctgctaaggcaggtatgattatctaccgtcaacgtggaacacatatttaccctggtgtaaatgttggtcgtggaaacgatgatactttgtttgcacttgcagatggtgtcgttcgttttgaacgtaaaggtcgcgacaagcgtcaagtttctgtatatccagtagcagatgctgaataagctttaaaaaagcaaatttcaggtcgggacaataactttgttccggccttttttaatgattttcttgttaaaaagagaatcgattgatatcattagttctagaattaattggaggaatctttttatgagtacaatttcaacatctgattttaaaaatggtttaaccattgaatttgatgataatatttggcgcattgttgaatttcaacatgttaagccgggtaaaggtagtgcctttgtgcgtactaagttgaagaacttaagaaatggcgctgttcaagaaaaaactttccgtgccggcgaaaaaatggaacaagctaatattgagacaaaacgtatgcaatatctatataatgatggtgctaactacgttttcatggataacaatacgtatgaacaagttgaaattcctaatgaacgtcttgaagaagagaaaaattatttagttgagaacatggaagtaagtatcgcattctttggtactgaaacacttggtgttgaagtgcctaagaatattactttaaaagttactgctacagaacctggtattaaaggtaatactgctagtggtggctcaaaaccagctacaatggaaactggtctggtggttcaagttcctttcttcgttaatgagggagatgctcttaacatcaatactcaagatggtacttatatttcacgcgcttaatttttggaggcaatataatggcagatacgaaatacttggagttaagtaattctagttcaaagagtggcgggattgcgatagcacctgatgttattgaatcaattgcaggaattacggttgatcaaatcgatggtgttcacttaattggtaataatatttcgaagggcttcaatacaattttaggacgtgattccttgggattaggtacaaaattaattgaagatgatcgtggcttagtcattaatgttagtgtaatgcttgattttggggtatctgttccacaagttgctactaagattcaagatcgagttaagcaacagatgttgtttatgaccgaaattgtgattaatgaagttaacgtgcaagtcaacggaatgatgccagatacgacaacatctgatattgatcccgatgatattttttcagaaaataatggtgataaatagtgagtttaaatcgacatcaaattcgagagagcgcctttaagattatctttgctaaaagtgctaatccagacgctgatctaagcgaattgcaagatcaagttttagaagaatttcatgagacagaagcccccgatcaattcttaaaagatttggttatgggagttagcttaaatcttgaagctgttaatgaaatgattagtggagagttgaaaaagggatggacagtaaaacggttagaaagtcctgaccgcgttatattacagatgggtacttatgaaattaagtacactgaaacaccagataaagttgcgattaatgaagctttggagttagctaagaagtatactgatgaagacgctcgtaaatttatcaatggagttttatctaatatcgcaaaataattaaaaaatggttgtgaatatcacttgatatttacaaccatttttaatttgtttaagatttaaaaagaaaatgcatcttatgatatgatttaagatgggtaaatatttgaaacggaggagtaataatgggccaaattattgatggaaaaactttagctgctgagattgataaacaaacaatgactgaagtacaaaaattgaaaaatcaaggtgttgaaccacatcttgttgtggttctagttggtgaaaatccagcaagtcaaatttacgtaagaaataaagaaaagcgcgctaataagttaggcattaaatcaacgctagttacgatgaatgccgatattagcgaaaatgaattgctcctaaaaatccaagaattaaatcaaaccgaagatgtgaatgccattctggtccagatgccactccctaagcatattgatgcttttaaagtaacgatggccattgatccgcgcaaggatgttgatggctttcatccagttaacgtggggaaacttttcgaaggaaagacgcaacacacgcccattgcatgtacaccgcaaggaattatggagatgttccaaaaatatcatatagatattcaaggtaagcgtgcagtagtggtgggacgtagttcgattgttggaaaaccaatggctgcattactattgaatgccaacgcgacagttacattggctcatagttatactaaagatttagccgctctgactaaagaagcagatatcttggtggtcgcaacaggtattgcccattttattaaagaagatcaggttaaagaaggcgcagctgttatcgacgttggtatggaccgcgatgaaaatggtaaactaacgggagacgttgatttcgagaatgtcgaaaaacatgtttcatacatcacccccgttcctaagggcgttggtccgatgacaatatcaatgttaatgaaacaaacggtgaatttaactaaatggagtatttaaatgcaagaagataagtatttaacggtcagtgcactaaccaattatattaaacgaaaatttgatgctgatccgtatttacatcgcgtttatttagtgggggaaatttcaaactttcgcttaagaactaacagtcaccaatattttagtttgaaggacgaaaacgcgaagattagtgcgatcatgtttaaatctgcatttgcgaaggttaagtttcaacctgaagaaggcatgcgagtgattgtgagtgggcgaattagtttatacccaggaaatggtagttaccaaatttatgtggatagtatgcaaccggatggtgtaggagctttatatcaagcatatgaacagttaaagataaaattatcccaagaaggtttatttgaagcccctaagctaccaattcctaagtatccccgtaagattgcgattgtgactagcccttctggggccgtgattagagatattatcacgacggtgagccgtcgttatccgattgttcaactggttttatttccagctttagttcaaggtaatgaggcagccaatagtatagctgcacaaataaagatgattaatacgttggatgattttgataccatcattattggccgaggtgggggctcaattgaagatttatggccattcaatgaagaagtagttgctcgagcaatctttgcaagtaagttaccggttatttcctctgtcggacatgaaacagatacgacaatcgccgatttagttgcagatatgcgggcagcaactccaacggccgccgctgaactagctacccctgtactgaccgatatcttagaagagcttcaaaaactccagctacaaactattggggcgtttagaaatattttaaaaatgcgtagccagcaggttcaacatttacaacaatcgtatatttttcaagaacctcaacgcttatatgaaggttatgtgcaaaatgttgatattttaacggaaaagttgatttcgttggagaaacaacaaattactacagctgagggatcatttaaaactctaaattcacgattgttagccaatactccagctagtagaattaaaatggcaaaacaaaatgttgagcatctacgacagatgaccaataataatataactaatcgtttttcaaagtatgcgaatgatttgaattcgctgattggatctttagatactctcagccccctcaagataatgagtagaggttatacttatgtaactagagatacgaaggtcgttaaatcgattgaggatttatcaattgacgataaaattcaactgaattttagtgatggtagtgcaaatgcagtaattaaaacaattaacagcgaggataaataatggctgaagaaaaaacatttgaagaaaatttacaagaattacaacaagttgtttccaatttagaacaaggtgatattccattggaaaaagctttgacagaatttcaaaaaggaattcagttaagttcggaattacaagaaaccctaaaaaatgctgaaaaaactcttacaaaagttatgcaagacaatggtgaagagactaacttagatttggggacagacggagaaaatgaatagtaattttgatgactttgtcaaacaaaacgtagaattacttgatcagcacatcgatgaattgtttgatagtgattcaacattgaataccgatttaaaaatgatgatgaagtattcaattgacgctggtggcaagcgagttcgtccgttagttttattggcaattttgaaagcattcagaaagacccctaattacgatatcctaacagtcgcagcagctctcgaagctgtacatacatactcgttgattcatgatgatttacccgcaatggataacgatgatttacggcgtggacgaccaaccagccataagaagtttggtgaggcagaggctatcttggctggtgatgcacttttaacggtggcctttcaatggattagctcaaccaatttaaaggatcggattaaaagtgaattggtgttagccttggcaagtgatgctggggcttcagggatgattgctggccaattattggatattcaaggaaatcagcgacattattccttagctgaactcaaacatttacatcatcttaaaaccagcaaaatgctattattcccagcggaagcggcgttgataatgaagccaagcaaacttcaagttgccgaattggttaaagattttatggcaaactttggtttagcctttcaaatccatgacgatataattgatgtaacagaaagtacagcgatccttggtaaaacggctggaaaagatgtagatttaaataaaaatacgtacgttaacttactcgggttaagtggagcaaaagaagaattaaatcaggttcttcaaaaatgtgaacaagacttaacctccttaggtgaattacagccagaaatggatttgatgattttagaaggttttttaacgtatttaaaataatggagaattaacgatggcaaaagaacgcgtagatgtattgctgatagaacagggactttttgatacccgtgaaaaagcaaaaagagccgtaatggccggagaaattttaggagacaacgaggagcgtttggataaacctggtgtcaagattgacccttcagttaagttacatttaaagggtaaaccaatgccctatgttagccgtggaggcttaaaattagaaaaagcattgaaagtctttggccttgatgttaaggggcttacagtattagatgtaggttcttcgacaggtggatttactgacgttatgctccaaaatggtgcgaagcttagttatgctttagatgtaggaactaatcaattagtatggaaattacgtgaggacccacgagtggtggtaatggaaaatactaattttagatacagtaaattagaagactttactgagggacaaccagagtttgcatcaattgatgtttcatttatctcattaaaactaattttaccagcgcttaaaaatattattaaaacgcatggatcagttgtcagcttgattaaaccccagtttgaagccggtagagaaaatgttgggaagcatggcatcgttcgtgaccgtaaagttcatgaagaagtccttaaaaatgtactagcaatggccaatgcggaaggtttcaacgtaaagggacttgatttttcaccaattaagggtggagaaggcaatatcgaatttttagcctggcttgaacgatccgatacggatcaaggagtgattgaagagaatgttgatacccaaaaagtgattgatagtgcatattccaacttaaattcataggtgaaacaatgcgaaaaaacgaccgacatgaactaattaaacaaattatcaacgaaaatgaaattgatcgtcaagaagatatcgtacttcacttgcaggagcagggcgttgaagtgacgcaggcgaccgtttcaagggatattcgtgaattaaaattaattaaatcacccactaaaaagggtggagtacgatattctctccctaaaggggatacttcccaaattgaacaacgactttttacgttattaagttcggctttgatttcaattaaagttcaggaaaaatttgtgtttattgatttaaagccaggaaacggagctagtatttcagcaacgctaaaacaggtccactatgggtttgtttttgcagcagttagtgatgacaatggagtgctagttatttgtactgatgatgaacatgcagtccgattaaaggatcggattacacaatcaattgcttacatctaggagaattagatatgttattggaattatctataaaggatttcgcaattatcgagaagcttgatgttagtttcaaccaaggaatgactgttctgacgggagaaactggggcaggtaagtcaattattattgatgccgtaggacttttagctggtggaagaggctcagcagattttgtaagaaccggcgcagacaaggcggttctacaaggtgtttttgatatcgctgagattgataatactaaaaatgcgttaattaagttaggaatcgacgcaaccaatgatttagtgattactcgggaactccataagggtggtcgaagtgtttgtcgaatcaatggcacgatcattaatctaaatagtctaaaatcagtcggagaaactttaattgatattcacggacaaaatgaacatcaagaactaatggatagtgaaaaacatctagcattgttagatcattttgacgaaaaaatggttggtaaagtccgtgctaaatatgaagaagcttacgctgattattttaaattaaaccaacaattaaataaaagtcgtaagaacgaacatgaatggaatcaacgcgttgacatgttgcaatttcaagtggaagaaattaagtctgccaatttaatggctggtgaagatgaggaacttgaaaaaagacgggatcaattaaacaactttcaaagtatttccgacgctctttcaacaagttttcaacttttggaaggtgaagatggggcctctgcgattgatcaaattggtagcgtaatgcaagaattacaaagtatttctgattatgatgatgagtaccaacaagtttctgatgaggtacaaagtgcctattatgctttagaagatgtaactaatcgagtccgttctgcgcttgatgcgatggaatggaattcaaatgaattagacgaagttgaacaaaggttagaagtagttcgtcagctaaagaaaaaatatggtaattcaattgaagaaattcttaactatttgaataaaattgagaatgaactcaatgaaatgactggttcaggaaacaatttggatgatcttgcccaggaagttgaagcgaggtatcaaaaagttaaaaaattaggaactcaactcacggaaatgcgtcaaagaatggccttagcattagaagcagctatacgtgaacaattgtcaggtctttacatggaaaaaacacaatttaaagtgcaatttactcctaaagctgaaccagatcgaaccggatttgatggggtagaatttttaattcaacctaatcctggtgaagatttgaaacctttagcaaaaatagcgtctggcggagagctctcacgaataatgttagcgttgaaaactatttttgcgcgtaacgaaggggttactagtattatttttgatgaagttgataccggagtaagcggccgtgtagcacaagcaattgcagataagattcatgaaatttcggcccattcacaagtattgtgtatttcccacttaccacaagttgcagctagagcagatcatcagttgcatgtggccaagaaagtggtctatggacgtacaatgacgaatttaacagtgctgaatgacgaaggacgggttaatgaaatcgccaaaatgttagccggggttaatatcacggaattaagcttagaacatgctcgtgaattattaaaaacggaacaagcccactaaaaaactcttactagcaaattgaaagatatccttgattcttagggatattttcggtttaatggtgagagtttttaaattaaggcgatgcttcgaatttgttgatcttctaagagttgtgttagcccagttttaggatcagtcaggcatagtcgtccagatctggtaatctggatatagccatcgatttcaacgattgatttttttaaatccagttgcatgcggactactaggtgattttgaattgaatatgccagggtatcattaatttgatcaatgggcattgtacgatccataattggtaaaccttggtcttcagggaccaggaataagttattatacattttacggatgttattgagtgagtgattaattcgattgaaagagttattaaattttttgttttccatgttagcctccaacgaacatttgtttgtatttacattatacgaacatgcgttcttaaaagcaactgtttttatgaattgggtataaatgttggtgtagcgctaacgattctgtagtggggaaattcaagaaaaataaaactcgaaaaattagcgctgatgtgataaaaaagcgaacaatttaaaaaagttaaaagtttattaacatggtactttaattttcaagtcaattgtggttgaaaaatataataaaaaagtgcaaaatagaagttacatatatattttgaggagtttgttcatggctagaagaggaatgttgattgttctatctggcccttccggtgttggtaagggaacggttagaaaggcaatctttgatcaaggcggtaatgattttcagtattcaatttcaatgacaactagaaagcctagaaaaggtgaagttgatggtgaagattactactttgtctctaaagaagaatttgagaaaaatatcaaagaaggccaaatgctggagtatgcccagtatgtagataattactatggcacaccattaaagtatgttaatcaaactctagattcaggacgagatgttttcctagaaatcgaagtgaacggtgctcgtcaagttcgtgaaaaaatgccagacggggtatttttattcttgactccaccagatttgatggaattaaaacaacgtattatcaatcgcgggactgaagacatggatacgattaataaacgaatggaaaaagcagttgacgaaatcaagacgatgcgtgattatgattatgcagtcgttaacgacaagattgaaaatgcggttgaagaaattaaaaatattatcaagggtgaacatcttcgagtaaccagagtttatcctgaatatcaagaaatgttaggagaattataagatgattttatatccttcagtagatgatttactagaacgtgttgattccagatattcattgattatgcttgctagcaagcgtgcacaccaattggatgagggtcaaccagaattactagataaatacacttcacaaaaaaatgttggcaaagctttggaagaagttgttgctggcgatgttatcattgatccaaacgaaaaagatttatagaaattatgaaagatggtggaggttgtcctctagcatcttttttgttggattaatcaattagtgggattggtattcaaggactggtaaaatagcagaaggaggttgttcgatatgaaaattttatttgttattactggcggaattgccgaatataaagtggttgaagcggtacggtttcaaatcaaaagtggtaatcaagccaaggtagtgatgacgcaaatggccaaaaaattcgtcacaccattaacgtttgcaacacttaccaatgaccttgtctatgatgattttgaaattaatacggaaaacccagttgctcatgtagctctggcagactgggcagataaaattgtaatcgccccagccacggctaattttattggaaaaatggcgaatggaattgcggatgattttgcttcaactgtagtgattgcttcaacagcaactaagctgttgctgccagcaatgaatgttaatatgtggaataatccagcggttcaacggaatatcgaacaattaaaagtagatggagtagtcgttttagaaccagctgttggagagctggctgaaggttattctggaaaaggacgttttccggatgctgaaatcgtaaatgcctttatcagcacgccccttgaaaagcgggaaaatctctttaaaggaacacacattgtggttactgctggggggacgcgtgaagcgattgatcccgtacgttatatttgtaatgaatcatctggtaagatggggtttgcgcttgctcaagtagcagaacggttaggagcgcaggttactttaatttctggacctacaaacttagttttaccagcgaaatcaagtattcaacggataaatattaagagtgtagcagacttacaggccgcccttgatacagcagtacaagatgcagatatattgataatggccgcagcagtttcagattaccgcgtggcgaaaatagcagatcataaaatgaaaaaagatgattttaatggtgaactggaaattaaattgattgaaaatcctgatattttagcgacactaaaacgtccagactcacttcgatacgttgtggggtttgctgcggagacgaatgatttaattgaaaatgctcaacgtaaaattcttaagaaaaacctaaatatgattgtggctaatgatgtaggtaatccccaaatcggttttgaatctaatcagaatgctgtcaccattctacgtccgcaccaagctaatatagaattgaaaaagaatgataaatcgataattgctgaacagattttaaagctaatcgaccaagaaattaattgaaaggaacgtaactcatggcaaaaaaatttaatgtcatcgtaaatgtcccagctttacaaactaatacaccatttacatatatcgcaaatgatgccattaaaaatgacattaaaattggttccagagtaattgttccttttggtaagtctgagcgacctatccaaggttttgtggtcggagaagaaaccactaatgaatttgaaggattgaaggacatcatttcagttttagaaccggaaccattgctaaataaagaattgattgagctttcagagtggttagccgaccaaacgtatgcttttcgagtaagttgtttaaatgcaatgcttccaagtttggtgaaagttaataccaagcgttttattaaaatcaatgaaacaaaaactacaatggaaaccgtgattgccttattaggggaagaacaggttacagatcttaaagtaaatgaactcagttttagccaacaaaaacaacttaatcagtggattaaagatgaattcgttacattaaaatatgtcacggaagattctgctaaaaagaaaatgattaattggctttggcctacgatggatttaagtgagtatgaacaagaacaaaaaaagttaagaaaaaatgctacgaaacaagttgagttactaaatataattaaaacgttagatgtcaaaaagggaatttcgcaagcttcaattttaaatgattatggtgtaggacgctcaacattaaatacagcggttaaaaatggatggctagttcgtaaggcggttgagcaatatcgcgatccttttgaaggacgtcagatgcagcttgatcaaaatttggctttaaatgaagaacagcaatccgcttacaacttaattacacaagcaattgaagacaaaaatgctaaaccaattttagttgaaggcgttactggatcgggaaaaacagaagtttatttgcagagtatccaacaggtaataaaaaaagggaaaactgctcttttactggttccagaaatttccttaacacccttaatggtgaaaagagttcgggcgcgttttggtacacaagtggctgttctccatagtggactttctgacggtgaaaagtttgatgaatggcgaagaattgtacgaaatgaagttaaagtagtagttggagcacggtcggcggtctttgcaccactacgtaatattggtattataattattgatgaggaacattcagaaacgtataagcaatctgatgcaccgcgttatcatgctcgagatgtagcgattcatcgtgcaaagaaatttgaatgtcccgtagtcttgggaagtgctactccttctcttgagagtcgttctcgcgtggaacgtgggcgatacgattttgtaaaaattcaaaaacgagccaatcaaaaggctttaccgaatattcaagtgatcgatatgcgtcagcatttaggtgatggatataatgaaaacttttcggcacccatggttgaagaaattcgacatcggattttaaggaaagaacaagtagttttaatgttgaatcggcgaggtttttcatccttcgtgatgtgtcgaacgtgtggttttgtcctaacttgtcctaactgtgatgtatctttaacgatgcatatggattctcgaaccatgcggtgtcattattgtggtcatgaagaagcaatcccacgtttatgtaaaaattgtggtagtgataaaattcggtttttcggtactggaactgaaaaagttcaacagcaattggcagagatcattcctgaagctcgcgtacttcggatggatgttgataccacccgtcgcaagggagcccatgagcgtctattagaacgttttggcaaccacgaggcagatattcttttgggtacgcaaatgattgctaaggggttggatttccctgatgtaaccttggtaggagttttaaatgcggatacagcattagaattaccagatttacgggcaagtgagcgaactttccagcttttaactcaggttgctggacgtgctggacgtgctgataagaccggtgaagtactaattcaaacctttaaccccgatcactatgcaattcgtttagctcaaaaacaagattatgaagactttttctataaagaaatgtatttgaggcatttaggcaaatatccgccttattactacacggtattagttagtgtttcagatcgggatgaaagacaagcgttaaaaaatgcttacgaaatgttgaatattattcaaccgcagttatcagctaatgcaattgtgttagggccgacggctaaatctatctcaaaaattaaacaaaaatattactatcaaattttaattaaatatcaaaaagagcctaaattacatcgtgcgctgttagaagtattgaacaaatcgcaggagaaatttagacaggggacacggattagtattgattccgaaccacaaaactttttgtaatatttaggaagtaggtctaattatgaaatcaattatttttatgggaacaccagaattttcggcgccaattttgcaaagcctaattgacgagccaaactatgatgtgattggggtagttacccaaccggatcgcaaagtcgggcgaaaacatgttttaacacccagtccagtaaaaaaagttgctgttaaaaacgatattaaggtttatcaaccagagaagttaagtggaagtactgaattgacagaactaatcgcgttaaatgcggatttaattgtcacggctgcttttggtcaatttcttccaatgagtttgatcaactccgttaagattggggcagtcaatgtgcatgcttcattattaccaaaatatcgtgggggagcacccgtgcactatgccataatgaatggcgacaaagaaactggtgttactattatctatatggttaaaaaaatggatgctggtgaaatgctcgctactgcaaaaattcctattaccgaccaagatgatgtgggaaccatgtttgaaaagttaagtcttttagggcgtgatttattgttagacacgctacctcaattaattgaaggaaatgttcaaccagttaaacaagatgaagaacaagttagcttttcgcctaatattagccccgaagaagaagaaattgatattaatttaccggcccgtctagtagatgcaaaggtccgcggattacgacctttcccagtagcctactttatgatggaaggcaaacgaactaagatatggaaaacaaaagtaatagatcaaactacagatttaaaaccgggtcaagttgtttcaaaaacgaagcatgagctcttgatagcaactggagaacacgatgtaattagtattgaagaattacagccagctggcaaacaaaagatgacaattacagactatctcaatggggtaggcgaaaacttacacccaggaaagcaaataatagataatgacaaatcaaaataatagtgcacgaaatttagcggttgatattttagaaaagattgatgaaggttctttttccaatattcaacttaatcaagatataaaaagttcatcattgattgatattgataaaaatttgttaacagaaattgtatacggagttttacaacatcgactcactcttgatttttatttagctgattatattagaaaaccagagatgactccgcgctgggtcattaatctactaagaacagctgttttccaaatggagtttctagatcgtgtaccggactttgctatttttaatgaatcaattgaaattgctaagcttcggggcaatgacggtatcagaaaaatggtgacgggtgtgctacgctcgtatcagagaaatggtaaaccaagttttgattcgatcaaaaatccagtggaaaaattatcgactcaatatagcgttgcgccttggattgttgatcaaatgttatacgaattgggtgaggaaaaatgcatttcgattttgaagagtattaaccaaccgtcccatcttgcggttcgtattaatcgttggaataaaacacatgcggatattattaaagatttagaatatgagtatacggtaacgacaagtgcaattgctaaagatggtttacgccttagtagaggggctagtatttccgatacaagaagttatattgatggtgatttgaccgttcaagatgaatcagcaatgttagttgcagaaacgatgcacttagagaaggggcaaaaagtactagatgcttgtgccgctccgggggggaagacgacccaaatagccgcaatgattggtgaaacaggagaagtaactggatgggatatctatcaaaaacgggtgcaattaattcaagataatgcacaaagaatgcatctagacaacgttaaaactgaggttcaggatgccattgcatctcgtgaagatttagatgaaagttttgatcgaattttagtagatgcaccatgttcgggaattggtttgatgagaagaaaaccagaaatccgttatcttaagagcaagaaagatagtagcgaccttcatcaactccaattaaaaatcttggataatattgctaaaatgctcaaagtaggtggcgtactaacttatagtacatgtacaattttgcgtaaagaaaatcaagaaaccatagaaaaattcctagctatccatcctgaatttgaacaactcaaagttgaaacagctaaaaaaatcaagcaaaatcgagatgaattgagccttaatatttatcctgatgattttgaatcagacggctttttcatcgctaatttaaaaaaggtgaagtgattggtgttatgaaatatgcgtacctatctgataaaggacaagttcgagagactaaccaagactatgtaggaattttcaaaaatgattctgaagctattttaaccattgtagctgacggtgtgggtggcaatcggggcggcgatgtagcttccgagatggccgtttcacacattgggtatctatttgaaacttctgacgttaataatgttactgatgctaaaaattggttaattcgccaacttgctcttgaaaatcgtaaaattttgcaagcatctaagcactataaaaaattaaatggcatgggaacaaccatcgttttggcactctttttaggtaagcaagtgattgtagctaatcttggcgacagtcgttgctatttatatagttcgaaaaatgggttgaaacaactatcgaccgatcactccttagtgaatgaactacttcgtttaggaaaaattactcctgaagaagctcgtaaccatccagaaaaaaatgtaattactaaaactttaggaatttcagaacaagccgaagctgagattaaagtatttgatattaccaaagaagatgaattgctactttgcacggacggattaactaaatttgtttctgatgatatgatcaaaaatgtgttgatgagtacgcttagccttgaaaaaaaagctaatcagttagtagatatggctaacactgcaggtggaacagataatattacaactttaattgttcaagtagaagagggggatatattatgacccctaaccaaactttgaatggtcgatataaaattattcgaccacttggagaaggcggaatggctaatgtttatctggcacatgatttaattttagatcgagatgttgcggtaaaactggtccgttttgacatgcaagatgatgtttcagcaatcaaacgattccaacgcgaagctttatcgactacagaactggttcatcctaatattgtcggtgtttatgatattggcgaagaacatggaatgaactatttgattatggaatatgttgaagggcaaaatcttaagcaatatatcagagatcagtttcctataccacttggtcaagtagttagcctaatgagtcaaattttaaatggtgttcagacggcgcactatcatgggattattcatcgcgatttaaaacctcaaaatatcttaattgataaacatggaaaagctaaaattactgattttggaattgcgattgctaatcaacaaagtagttttacgcgaactaatacggtgattgggtcggtacaatacctatcgccagagcaagtacgaggacacattgctacgcaacaatcggatatttattcattaggaattattttatttgaaatgttgactggaaaagttccttttgaaggtgaaagtgccgtatcaattgcggtaaaacattatcaagaccagttacctttggtgaaggattttaatacaaaaattccccagtcattagaaaatgtggttttgaaagcaacagcaaaaaatccaattgatcgatataaaaatgttgccgagatggctgctgatttgaagacggttttacagcctgaacgggctaatgaaagcaagtttgtggaagattctttggtagaacatacgattgttttaaatcaagacgaattaaagcagggattagcaaaagatgaggttgaaaaaactcgaccaattaagttaaaaatgaacaataaaatcaattttgctaagaaagaaaaagcaccagatgctgaagaaagtcatatgcatcgctttaaacgtcgtcatccattacggagaagagctttatttatggcaatggccgcggtagcttttattttaggaattttgattgctttcaagttgagtagtccgcaaatggtacaggttcccaatttagaagatttaactcaaaaacaagctatgactaaactatcaaaagtgaatttaggagtcggaaaaataactaaagaagctgatgataaaacgagttataataaagtagttgaaacgcttccacaaagtggaaaatatgttcaagaaggaatcaaagttaacattgttatcagtaagggaccgaacagttttgatgtcgataattatgttggaagtgattatagtagcaccaaaaagcaattggaagctaaaggatttaccattaaaaaaagaaaaatagttaccaatcgtttcgataataatcgcatcatctcccaagatgttgtatctggtcaagtggttgtgccacgagtgacaacaattacgtttacggttgctaattaacggaggacgcatgcatactggacaaattatacaattattagcaggattttatgatgtgttaacagaagaccataaaatcgttaggactcgggcacgaggtaattttcgcaatcaaaaaactagcccgttagtgggtgatatggtcgattttaaggaaagtgaaaatgatactggatacattaccaaaattcatacgcgtgaaaatgagttggtgcgtccgccattagctaatatcgatcaagctgtaattgtcactgcagcaactcagcccagcttttcggcaaatttgcttgatcgtcaattagtggcattggctgaaaaacatattgaggctattttgtatttttcaaaaacggatcttttaagcccaacggagtttcaagatttacaaaaaattgccggctactaccaaaaaattggctatcaagtgatttttccaattagtagtcaacctgatgctgatttaatcgaattgaaagagtcatttaaaaatcaactaactatttttatgggacagactggtgcgggaaaatcaacgctcttaaatcgaattgattcaaagttgaatattgccactggagaagtttcacaggcattaaatcgtggtaaacacacgacgcgtaaggtttctttgattcccattgaagatggtttagtggctgatacaccaggtttttcaacttatgcagtttttgaaatggctgatacacaattaaaagaatattttattgattttaagaagctcagccaaaattgtcgttttcgagaatgcttacatctaaacgaaccgggatgtgcagtcaaagcggcagttgaagacggtagtgtgctaagcagccgttatgctaattatgaacagtttatcgaactgattcggagtcaaaaacctgaatataagcgtaaaggttatcaaaaaaaggaccggaggaagaagaaatgattaaagtagccccatcaattttaagtgcagacccagctaacttaatgggtgatattaataaagtagaaggagcggactatcttcacgttgatgtgatggatggcagcttcgtacctaacttaagttttggactaaatacagttcaaggattgtcaaaagatacagatatcaaattagacgtacatttgatgattcaaaatccagaaaactatgttgaacaatttgttaaagccggtgcaagtattgttggtgttcatgttgaaagtactcagcatattgcacgagcaatccaaattatcaaaaatgctggagctcgcgctgaagtagtagttaaccctggaactccattaacagaattagaagaactattacccgaaattgaccaagttttgattatgtcggttaacccaggttttggtggacaaaagtttcttgaaagctcaatcagcaaggtgaagcgactatctgcattacgccaagcacgtggattagaatttgatattgaaattgatggtggaatttcagacaaaaatatcaaagcggtctatgatgctggcgtagatgtagccgttgctggttcatacgttttcggcgctgaagattacaccaaacaagtgcaactattaaaggaacttacaaaataatgaaaatttttaacttattagttggtggagctccagaaaatttacctgataatttaaatgattttgaaggagattggattggagtagatcgtggagctttaaaactgattgaaatgggtttaataccagaagtagcagtaggagattttgattcggttaacgaccaagagtttaaagaaattgaagctaatgcaaagcaagtaattaaactagatccagttaaagatgatacagatactgaatcaggattaaaatatgctttagatcatgatcctcgcgctcatattcgcgttttagggattagtggaggaagattagaccatttacttgccaatgtattaatggtcctccaagaccgttttagaatgtttgcagagcaaattgaattaattgatcgacaaaataatattagattttttaattctggcaaacatacggtcgacaagttggaaggttttaaatatttatcttttatcccattaacgcaaatcgatgttttaacgttagatgatgaaaaatatgaattacataatgcaatggtttcaaatgctcgtgcttatgttagcaatgaatttatcgattctaaggcgactgtttacttgagtaacggattggtagcagtaattcaaagtaaagattaagacaaaataaaaaaaagattggttatcaactaaccaatctttttttatacgcgtgtaactttacctgattttaaagctcgagcagatacccaaacacgtttgggcttgccgtcaactaagatacgaactttttgtaaatttggcttccagcttcggcgactgtggttcaaagcgtgtgaacgagtatttccgaagcgagtgtgcttacctgtgacaaaatcttttgccatgtcgaaaccctcctttgtcacttctatatttttatagaaatctttttcaatcaccataacaatttatcatattgcccgctatattgcaataggaaactttcaagtaattatccttgacactcaaataatccgttacgttttcaaaaaggttgtcacttaaaaaaatttattagaataaatgaatatcctcggtataataataatcagtatccaattcagatgtttgctcttgtatttaatgcatgtatgggatatggtaaaatatcgttggtatatatgaatactaaggaggcaggggtatggctgtcaagataaaaacaaaaaatggaacaattaacgtttcaaacgatgtaattgctactgttgttggcggagccgcaactgataattatggggttgtcggaatggctagtaaaaaccagattcgtgacaacataaatgaaattctaaaaagagaaaattacgctcgtggagtagtaattaaacaagaagcaaatgggatcgccatcgatgtttacattatcgttggatatggtactaaaatttctgaaatatcaaaaaatgtacaatcaaaagttaagtacagcctagaatcaatgcttggcatttctgctaattcggtcaatgtttttgttcaaggtgtgaagttgctcaacgattaggttcgttgaactaggaggataatgaatttggaagcaataggaacattgattactaatgaagtttttgatcagatggtgcaagccagttctgatcgtttaaaaatgaatgcggattttattaattctttgaacgtttttccggtaccagatggagatactggaacaaatatgagcctttcacttgaaagtggcgcaaagtatgaaaatgacgatgctagtttggaagtagggcatttagcggcttctttagctaaagggctcttaatgggagcacgtggtaactctggggtaattttatctcaaattttccgcggatttgctaagagcgttgaaggtaaagcaacgcttaatgctgaagatttagccgaagctgtcgcagaaggcgcaaaaacggcttataaggcggtaatgaagcctacagaaggaactattctaacagtggttcgtgaagctgctaaggcaggtaacgaggcagttaaaacgactgatagtttagccgaagttatggacgctattgatagtgctgcacaagcagcccttaaaaagacgaccgatcttcttccagttttaaaagaagtaggcgtagtagattccggtggtcaaggtttagtatttgtttttgatgcgtttaatgacgttttgaatggtaatgatattactgaatacaagcatgaaccggatgctactgaagtaaatgaaatggtagatgctaaacaccatcaaagtgtacaaggaaaaattaatccagaagatattgaatttggatattgtactcaaatgatggttcgaatcggaaaaggactgcaagttactaaggagttcgattacgatactttctacgattatctagctaagatgggtgattcattactagttatcaatgatgatgaagtggttaaggtacatgttcataccgaacatcccggcgaagttttagcttggggtcaacaatttggtgatattaccaaaattaaagttgataatatgcgttggcaacaagaagaaatcatagaacaagatgaaacaccaacagcatcatcagcctcaaaagaagtggctcctgaaacagctgtaattgcaatttcatcaggtgcaggtatctctaaattatttactagtttaggggtaacgcatatcattagtggtggacaaacgatgaatccaagtaccgctgatatcgtagccatgattaatgattcaggcgctaaaaaagcgattgtgttgcctaataataaaaatatttttctagctgctgagcaggccgttgaggtagctgatattccaactaagattatccatagccggacaatttctcaaggaatggcagcaatgcttgagtttaatccagatgttgatttggaagaaaatgcagaagcgatggaatctaacttggacactgtcaaaagtggacaagtaacaattgcggttcgtgatactaaattggacggacgcgaaattcatcaagatgattatatgggattgattgatggtaaaatcgttaataccaatcctaaattgatggatgcaacggtcgaaatggttaaattaatgttagaggaagatagcgaaatcgttacgattatttacggtcaagatgctacttcagagatggcggaacagttgcaaaacgcaattttagatattgatgatgaccttgaagttgaaattcatgaaggtgaccagccagtttacccatttttagtttcagttgaataatacttataggtcggttattagccgacctatttttgatttacggagggaaaatgaaaagcttaacagactcagttcaagtgcttcctggagttggacctaaaagagtacaagcgttagccgaacttggtatttcgaccatagaagacttgattacttattatccatttcgatatgaagatttagccgctaaggaacctcaaaatgtcgttgatcaacaaaaagtgacatttcaaggggtggttgcaacccagcctacagtagctcgttttgggcgtcaaaaagtccgagttaactttcgtcttctaatcggtaatgagtccgttatggtaactttttttaaccagccgtggattaaaaatcaaattaatgctgatgaagaaattgcggtatatgggaaatgggatgctaaccgacggagtttaacaggaattaaaattattgatgaagaagcaaatcttcaacccgtttatcctgctaacaaacatattcgacaagccactattcaacaattagttacagatgcaattaaccaatacgaggaacaaattcaggatgttattccagaagaattgattactaaatatcggttactgcatcgattagcaatggtccaagcgcttcatttcccagcggatgatcaaaaaacacgggatgcccgtcgaactgcgatgtttgaagagtttttaacgtttcaaatgggattacagttggttaaatcacgtgaacgaattgaaaatggaacggcgattaaatatcaaattcaattagtgcgtgcatttattcaaaagttacctttcgaattaaccgatgcacaaaaaagagtaacgaacgaaattttggccaatcttaagtcccccgcccatatgaaccgccttttacaaggagatgtgggtagtggtaaaactgtagtggctgccatagcaatgtatgcaaccttgacggccgggatgcaagccacattgatggctcccactgaaattttagctgaacagcatgctaataatttaagtcgattctttgaaaaattagatgttaagattgcattattagtcggtggtattcgtaaaaaaatcagagatgaaatgctagcagaaatcaaaaatggtgaaattgatattgtagttggtacccatgccatcatccaagaagatgtccaatttaaaaatttaaggcttggtattatagatgagcaacatcgttttggggtacaccagagacagctactacgtgagaagggggcagctcctgatatattagccatgacagctactccaatcccacgaactttagctattactacgtatggagatatggacgtgtcaattattgaccaagctcccgcgggtaggaagcccattattactaaatgggttaagcgaggggaatgggaaaaagttttaacctttatgactaaggaatttgctaatggtcgccaagcctttattgtgaccccactaattgaagaatctgaagccatggatttacaaaatgcgatggaactttatcaagaattatgtgaattttttggagaaaaatatccgattgcaattttgcatggtaaaatggatggtgctcaaaaagatcagattatggcagatttcaaagaaggcaaatatatgggattagtttctaccaccgtgattgaagtcggggtagatgttcctaatgctactttgatggtaattcaagatgcggatcgatttgggttagctcaattacatcagctacgagggcgcgttggtcgtggtcaatatcaggcttattgtattttagttgcggatcccaaaaatgaagttggaaagcaacgtatgcaaattatggtagacaccaatgatggttttgaaatttcagaagcggatttgaaaatgcgtggtcaaggtgatttgtttggaaaacagcaatcgggggtccctgaatttaaagtgggtgatccggttgttgatttaggcgctttgcaaactgcccaaattgatgcggctaaaattgtaagccagccagcgtgggaccaagatccccgttaccaaaatttacgactttacttagaaaataaaatacaaataaataaaagtttagattaattaaaggagaagagttatgaagattgcagtggatgcgatgggtggagataatgctccagaggaaattgttaaaggggtaagcgaagccagaaaagctctaccagacgttgagtttatcttatatggaaaaaaggatgaaattgctaaatacatggacgattttagaaatgttaaagtggtccatacagatgaagtaattacaatggaagatgaacccgttaaagctgtgcgtcgtaagaaaaattcatcaatggttttagctgcccaagctgtaaaaaatggcgatgcagatgcaattttttcggctggtaacacaggtgcccttttagccgctggtttgtttattatcggacgtattaaaggacttgatcgcccaggaatgacaactactttgccaagtcttaaaggtgaaaatgataatttcactatgctagatgttggagctaacgctgaaagtaaagctaaaaacttgcatgattttgccattttaggtaacttctatggtactaacgtcatgcatgttactaatccacgaattgcacttttaaataatggaactgagtacgataagggagataagattcataaagaggcctaccaactacttaagaatgatagttcactcaattttgttggtaatattgaatctcgcgaattattaaatggaactgcagatgtagttgttactgatggttttacgggaaatgctgttttgaaaaacattgaagggacagccttatcgatgttgaaactagtcaaagaaacaattatgaacaacggtgttaaaggtaagatgggtggtctactccttaaatctgcttttagccaaattaaagaccagatggattattctaaacaaggtggagccgtattattaggtgtcaaagctcccgtagttaaggctcacggttcaagtaatgctaaccaagttaaaaatgctttggtacaagtacatgaaattgtagattcaaagctcgttaagaatttagcggattattttgagatgcatcttgaaagcatcaaacaagatgatgtagacaaagaaaacgaaaacaattaaaatactaaagatattcaataagtagaggagtctgaaaattgtcaaaagaagaaatttttaataaaattgctgaaattttagcagatcggtttgaattaaaaaccgaacaaattaccaatacactaaactttaaagaagatttaaatgctgactcaattgatattgttgagttcgtgttagagttagaagatacttttggagctgaaattactgatgaagctgctgagaacctagttactgttggggatgcagttgattatattagtgaacatcaggcttaatttcatatactaagagaactcggtgattaatctaattggtcaccgagttattcttatgtgctaaataaattaatagatttggaaaggaagatattcatgataaaagccttagaagatgacttaagtcagacgtttgatattcattttaataaccatgcgttgttagatgaagcttttacgcaagcttcttatgttaatgaacatccacatcaagaattaaaattttacgaaagaatcgaatttttaggagacgctgttttacaactaattgtctctgaatatttgtttaagcgttatcctaaaatgccacaaggaaaactaacccgtttacgagctgcaatggtttgtgaagctagttttagtgattttgccaaagaatgtcattttgaccaatatattcgtttaggtaaaggagaagaaaaatccggcgctcgccagcgctcatcacttctttgtgatatttttgaatcgtttattggtgctctttacctcgatcaaggtcgggcagctgtcgagcgttttgtacgaatcgtcattttccctaaattagacgaaggcaaatttgatcacattatcgaccataaatcagaacttcaagaattacttcaaaaaaatggagacgttgaaattgattatgaattagtttctgaagaaggacctgaaaatgatttaatctttacggttagtgttacggctgatcataaaaaactagcaactggaaccggacattccaaaaaggttgctgaacaaaatgcggctaatcaggcgctacaacttttacgtaggcctaaataggtattttaaatgaaactacgcacgattgaaatcagtgggtttaaatcatttgctgataataccaagattgaatttaaagatggtattactggaattgttggtccaaacggttcggggaaaagtaatattatcgaagctattcgatgggtgatgggggaaacctctgctaaaagtttacgtggtggcaagatgcctgacgtcattttttcaggtaccgaaaaacgcaaacccctttcaagagcatccgtaacaattatatttgacaattcggatcactttctagattctaaatttgatgaagtaatgattagccgtcgactttttcgaaatggagaaagtcaatatgaattgaatcgccaagaatgccggttaagagatattttgaatttatttattgatacagggttaggtcgtgaatctttctccgttatttctcaagggcgtgttgaatcaatcttcaatagtaagcccgaagatcgtcgagcaattattgaagaggcggcgggagttttagagtataaacaggataaaaaacgtgctgaaaatgaactagaaaaaactagtggttatctagaacgggttaatgatttaattgtcgagctggaaaaacaagttcaacctttagaggaacaggcagccgtcgctaaagattatgtacaacaaaagcgtcgctttgacattttagatcagacgaaattggttcgaaccattaacagtaattctgaagctcaaaagcaattagctgtccagcgtcaagaacaaaaagaacagctcgcccaattacggataaaatcggaagctttagctgaccaacgagaaaaaattaaaaaagtaataagtgaacaaaatcatcaaaaagatcagttgcaaattaaattggtcaaattaaatcgactagagcaacaattagaaggcgaacatgatttacgggtggaacggcaaaaatatgtagatcaagaaaaagaacgtttagtaagcgagcaacaagtattaaaaaaacaacttgtcgaaaagcaagccgctttagaagccgcccaaggccaactagcagctgtgcaacagaagttaactaacactaagcaatctttgaaagtgttagaaagtgaccaccttgaacaacaaaaagaagctttaaagcgtgaaattgaagatttgcgggcagaatatgttgatcaattacaggcattgacttcattaaaaaaccaatataattttaatcaacaagatcgtgaacgcgatcaacagcaaagacaaaaaatccaacttacgatggatacgttgaatgaacaaattaagcaacgaaaaaccgaatgtgaaaatttggagcatcaattacttactttaaaagatgcaaataatgttcaacaagagcgaattactaaactgattaaacaacgggatcgacttcaagcccaatatgaaaaggaacggcagcagtggttagatggttccaacgttgctcatcgggcggaaagtaaattagaagctcttttaaatttgaaaaacgaatatactggattttatcaaggtgttcgagcagttcttcagcaaaaagcacaatttagaggaatcgtaggccctgtttcagaagtaatgaacgttccagctgaatatacggtagctattgaaacggcgcttggtaaccaagttcaaaatgtggtagtagacacggatcaaacagctaaatcgattattgaatatttgaaaaaaaatcgtttaggccgagtaaccttcttacctaagaatgctcttagtcagcgttccattagagaagacactttacaaaaggtgaaagaaatgccaggttttgttggtgttgcagctgatttagtcaaagtgaaagatgataatcaagttattagccaatatttattaggaacaactctaattgtggatacgttgcaaaacgctttaataatttctaagcagattagccgccataatcgaattattacgctggctggtgatgtaattggaattggaggaacgatgactggtggagctactaaaggcaaccgaacgggggtgctccagcaagaccaagaacttaaaaagttacaagtacaagtaactgcgatgaaaaccaagctagcttctaaagaaacagaagttcaaaaaattctagaacaaggacaagcaattcaagctgagttaaagcaagcacttgaagaacaacatcaagttgaacaaaatagctcagaattaagtaatcaagttagcttagaaaatgatcgactaacggaattacaacggcgacttaaggcaacacgttttgagctatcacagattgacgataatgaaaatcaacaaaatgatttacctgctcaaattgcgaacttacaacaagaagtacaacaaattaaagaaaatacaacggctaaacaagatgaacttgcccttttagatgacgatgttgatgaacgtcaaaatcggatttcagaacttcgaattgaattggctagacttaaggaacaaacttcacaacatcaacacgaagtgaatacattacagactacaattaacgatgtgttagaacgaaatgatgaaattaaaattaaaattcagcaattggatgaggaactaattccagaaaatgatctaaaacacttagatattgatgatattaggaatcaattagctgaacagaaccaattatcagcgcaactgcaaaataattttgaacaaaatcaagttcagcaagatcgcattattgccgattatgagattactcagcgacaattacatcaagctgaatcgcaattaaaggaaatcgagggttcactcacattagttcaaagtagaattgaaatggccattgataagttaactcaagaatatgaacagacttttgaaagtgtgcaaaatgtgattattcaaaatattgaggatgaatctttagaacgagagttgaagctgcttcgtagaggtttaaacgaattgggtacggtcaatctcggagcaattgaggaatatgatcgggtttcaacccgttataatttcttaagagatcaaaagaatgacctggcagattctaaagctcaacttgaacagtctattgctgaaattgatcaggaggctggacaaagatttaaacaaacttttgatcaagttgcagaagaatttagctcagtttttgttaaaatgtttggaggaggtaaagccgaattagagttaactgatccggataacctcttgacaactggtattgaaattaaggctcagccaccggggaagaaattacaacgacttagtttactttcaggtggggagaaatcgttgacagcaattacgttgttgtttgcaattttacaagttaaacctgttccgttttgtattttagatgaagttgaagcagcgtttgatgatgcgaatgtagaacgttttgctaagtatcttaagaattttcaaggtacaacccaatttattgtaattacacatcgtaaaggtacgatgatggaagccgacgttttgtatggtgttacaatgcaggaatcaggagtttcaaaaatggtatctgtttcaatggatgaggcggaataaagaaagcaggtgtaataatggcatggttttttggtagaaaaaagaaaaaagaacaaaaggttgaacaagaaccaacttcacaggttcaatctgaatcaatcagtacaacagtgaagaaggattctttaagtgagactcattcagagagtcaaagtacaattgcgtcacaggctgctgttgaaaagccagtccaagcagtagaaacaaatcaaattgaggagcccacttcttcaacagaaggagcttcgacgtctgaagttaaaactgaaacacagactagttcagctccagataatgggttggatgaagcagaacgctatgaccgcggtttggaacgttcaaggaaatcatttggacaaaaattatcagccttatttacgaatttttctggagtagatgaagatttttatgatgatttggaagaaactttaatcgaagctgatgtcgggtttgatacagcacttgaaatcagtgaggaagttcgggatgaaatagaatttgaacatgtttcagatcctgaccaaatttctcaattaatagttcgtcgcttagtggctctgtatactagaaatggtagtgcagaagataatcatttggtctttagcaaggagggtccaaccgtatttctctttgtaggtgtcaatggcgttgggaagacaactagcattggaaaaatggccgcccgctttaaaggacgtggccgtaaagtcttgcttgcagcctgtgatacattccgggcaggagcaatccaacagttgcaagaatggggtaaacgcgatggagtcgatgtggtggctggtaaagagcaatcagatcctgcttcagtagccttcgaagctgttaaaaaagctaaagaagaaaactacgatttattactagttgatacagctggtcgtcttcaaaataaggttaatttgatgaatgagttggataaaattaagcgcgtaattagtcgtgaaattccagatgctccgcaagaaacgttgttagttttggattcaactacgggacaaaatgccttaacacaggctaaggcatttttagaaactacgaatgttacagggattattttaaccaagttagatggaacggctaaaggtggaattgtgttagcaattagaaatcaattacatttagcagttaaatacgttggtttaggagagacggtggacgatcttagtccatttaatccagaacaatacgtaagtggactctttaagggtctgatggaagattaacgccaatggaaatcgaaaaaaataatcgcattaatagcttgttggaattttatgaacagttattgactccaaaacaaaaggagtatataacactgtattatgcggatgattattcattgggggaaatctccgaagaatttcaggtcagtcggcaagccgtgtatgataatattaaaaggacggtaaatattttagagaagtacgagcagcaacttcatttgttaagtaattttgaagtgcgtaatgcaaaatttgatcaaattcgtgcttatattaatcaaaaatatccggaagatactgaattaaaacactttttagatgatctcgaaaaaagtgaagaagaataaagacggaggggctttaaatggcttttgagggtctaactgaacgattacaaaaaactttcactaatttaagaaaaaagggtaaagttactgaggctgatttacgcgatacaatgcgtgaaattcgcttagcgttgctagaagccgatgttaactttaaagtagttaaacaatttgttaaaaccgtccgagaccaagcaattggctcagatattttagatggattaaatcctgctcagcaaattgtgaagttggttaatgatgaattaatcaagatgatgggaacagaagatgcaccattaaataagtctcccaaaattccaacaattattatgatgtctggtttacaaggggctggtaaaacaactaccactggtaaattagcattaaaacttaaaaatgaacaaaaagctcgtccacttttgattgcggccgatgtttatcgtccagcggcaattgatcagttggttcaagtcgggcaacaaatagatgttccggtttaccaagaaggcacagatgttaaccccgttgatattgtgcgccatggtttggaacaagctgctgaaaataaaaacgattatgtctttattgatacagctggtcgtctacaaattgacgaaaagttaatgcaggaattggctgatattaaagcgttagctcatccggatgaaattctcctggttgttgatgcaatgactggtcaaaacgccgttaatactgcggaaggatttaatgaaaaattagatattactggggtaattctaaccaagttagatggtgatacccgtggtggtgctgcgttgtcaattcgctcagtcactggtaaaccaattaaatttgttggacaaggcgaaaagatggaagatttggatgttttccatcctgatcgaatggcttcccgtattttaggtatgggtgacatgttaactttgatcgaaaaaactcaaaaagatttcgaccaaaagcaagcagctgaaatgactcaaaagattcgcgaaaacacattcgactttaatgattttgtggatcaattgaatcaagtacaaaatatgggaccaattgaggatatcatgaaaatgattccaggtatggctaataacccagctatgcaaaatgtgaatgtggaccctaaggatcttgagcacaccaaggcgattgtatattccatgaccaaagctgagcgtgaaaatccagatcttctaaatcctagtcgccgtcgtcggattgcggctgggtccgggcgtcctgtggttgaagtcaatcggatgattaaacaatttaatcaaatgaagaaaatgatgaaccaaatgtcaaaaggaaactttaacggcatggaaggtatgttaggaaatggaatcaagggtaagttgtcgaagatggcaatgaattccatgattaagaaaaataagaaaaacaaaaagaagcggatgaagaaaaataaacgacgctaaaaattaagaggtttggttatacaactaaacctcttttttgttttctaataaaagatactaggatctctactaaaagtatggaaatagtaccctagaaaaattaatgccaaaaataaatgaatcaaaaacagaaatgattggtatagggcgtatttacatgagcatccagaacggtctttatgtgccggcgagggtgttttaatagtacaagaagataatgagtggacatttaagtctaataaaaagtgttaaatttaattaaatgggagttttttcgatctgttaaggaaaaacactttacatctattcgatttactggtatattattactcgtgattaaatagttggaggtgtcattatgtctgtaaagatccgtttgaaacgtatgggttcaaagaagcgtcctttctaccgtgtcgtagtcgctgactcacgttcaccacgtgatggtcgttttattgcccaagtaggaacatacaatccattaacagaaccagcttcagttaaacttgaagaagaagaaatcttaaactggttaaacaatggtgcacaaccttctgatacagttaaaaatattttctctaaagcaggaattatgaagaagtatcacgaagctaagtatacaaaataggtcatacctgaacgaagggcgtcgataaaacattagttttattacggccttctttttgtatcggaggataaaagatgaattactttaatgtagcaaaaattgtcaatacccgcggtttacgcggtgaactaaaagttatctcatataccgatttcccagaagagcgctttaaatctggtgctgaactacaaatttttaagactgaaaaagacgaaattcctgttcaaactgtaacagttaaaaacgctaaagaatataagggctcatttatcgttactcttgaaggaatgaattccattaacgatgttgaaaagtttaaagggatgattttgaaagttgaagaagatcaactccaagatcttgaagaaggagaattttatcttcatcaaattattggattagatgttattgagaatgaccaaaaaattggaaccatcaaagaagttctatcgtatggtcctaatgatgtttgggtagttaaacggcccaatcaaaacgatttgttgcttccatatttaaaagatgtaattttaaatgttgatttggagcaaggagcagttcaagttagtgttccagaggggttagattaatgaaaattgatgttttaaccttatttcctaaaatggtagaagttccattgcatgaatccattgttggtaaagcgattgaagccggtaagttaaatgttgacgtcactgattttcgacaatattccactaataaacatggaaatgtcgatgattatccatatggaggcggagcagggatgctgctaacaccgcaacctatttttgatgcgatggagcatgttaagagccaaaatcaccaatccaccgggcgggttattttagttgatcctggtggcaagcaatttaaccaaacgatggctgaagattttgctaaagaagaacatctaacatttatttgtggacattacgaaggctatgatgagcggattaaaacacttgtcgatgatgaagtatccttgggagactttgtaattactggtggtgagttagctgcgttaaccatgattgatgctacagtacgtttattacctgacatattgggaaataaagattctgcagtcgatgattcattttcaacgggtctacttgaatttccacaatatacgcgacctgaagattttcgagggctgaaggttccatcaattttgttgagcggaaatcatggaaaaatcgatgaatggcgacggacagagtctttaaaaaagacacttgcaaggcgccccgatctgttagaaacagctcagttaacaccggaagataaacaaatcttacgagaacttcaaacgcccgatttataaaatcgttataggctattaagtccaaaataattttgcacttaataatagaatatgttaggatattaattggtttgaaaaccaacaataacaatgttccgctggctccgggtgagttgatgaagattggcgaagggaagatttttaaatgaatctattaattgataagattacaaaggaccaactacgtagtgatattcctgaattccgtgcaggagatactgttagagtacatgctaaggttgttgaaggtgaccacgaacgtatccaattgttcgaaggtgtagttatcaaacgccatggtagcggtattagtgctacatacactgttcgtaagatcagtaacggtgttggtgtggaacgtacattcccactacattcaccacgtgttgctaaaatcgaagttatccgtcatggtcgtgtacgtcgtgctaaactttactacctacgtgcattacatggtaaggcagctcgtattaaggaagaccgtcgtaaggctttcaaataaagagcaaataattaaagaagatgagttgaaatccaagagggttttgattcatctttttttgtttgccacactaagaaaaattaatataactattttaaataactcgtaaaaagggtaatgattattttgtttttcgcagaagagtacgttatgaaaaatgttcttctggtgggagcattcttagtgttatctttgagttgagtattgtggtaaacaaaatgagtcgaaaaatatggtaagtgaaattttagaggtagaattaacttctaaagacattcgcgggcaagttcaattagatatttaggtatagattatcctgataaactaacggatcatgatagcttgtttgaaaatcaaaaagtatcactggaataaaaaaggaagtttctgcgtaatttacggagaaacttcctttttttaatttatttaaacttaactgccgtaccataggcagccactgactgcatatctgtgccaattgatccagaatcaaagcgcatcatcacgactgcatctgcgcccattttcatcgcattttctcgaaggcgatcgactgcaatattgcgggattcatccaacattttagtgtagtctttaatctcgccaccaataatattttttaaaccagcaccaatattacggaaaatgtctttagattgggtagttaacccaaagacttctcctaaaacaatatattcctgtccaggaattttttctgtagttgtaactaaaatttcgtttttcattatgatttctccttaggataaaagttcatttaggtaattactagggccttaggtaatgatatcccaaggcttgcttctcaactaattctacgaccccagaagccacaatggtggaattgttaagcaaatcctccgtggtaattttccgctgggttaacgaattttgacaaactgcaatcactatctgagacgtaagagcgtgacggatcttttctgcttctttgctattggctttaacgcccatcacagcatcaccattgactaagagctcaatctgattattgggagcaggataagcttgtgctagatggtttagattatttaaaaccattggccactttgccatttcatcaatatggacgatgattttcataaaattattctccttagtagattaagattaaaaattagaataatggataatcatagtataccgctaataatcctggttaagctactgataacgtgcgttacacaaacgttgtttttgtattcaattgctttagtagagggggaaaatgattaataggctgcacaaaccgcatgagatagggatttctagtacacggggttaactaatgtggttatgattcgtgaaaacgttttcgatattgtaaaaaagctgtaaagtgttgatatgtaggtctttttaggcttagtgataaaaataaattttttactattattattttttttgattgcgaaaagactaaataccgattattctttttattattccaataacgttggagtacagatcattaattactaggaggaaataataatttgagtattttaaatacaacagagattatggaactaattcctaatcgttaccccattctattcatggactatgttgatgaattagaacctggaaaatcaatcgtggcgactaaaaacgtcacaatcaacgaagaatttttccaaggacattttcctggtaacccggttatgcctggagttttaatcattgaatctctagcacaagctgcatcaattctgattctaaaatcagaagaatttgcaggtaagatagcatatctaggtgccattaatggtgctaaatttagacagatcgtccgtcctggtgatgttttaaaacttcatgttgaaatgatcaagaaaaagagaaacatgggtgttgttgaaacatttgcaatggtcggtgataaaaaagtttgccaagcagaactaacattcattgttggagcaactgataagaaagataaatagtcggtgaattgcaatgggattgagaataattgattcagcactatctactcctaaaaaagtcgttactaacgatgatttaactaaaatactggatacgtcggatgaatggatttcaaaaaggacgggaatcaagcaacgttatcaagccgttgaagaaactacttcttcaatggcgatagaagtcgctaaacagctcttagagaaatctaaaactgatccaagtgaaattgatttgattgtcgtggcaacgatgtcaccggactatatgtcgccatctgttgcagctatagtacaagggagcattgatgcaaccaatgcaatggcttttgacattagcgccgcatgtagcggttttgtgtacggcatgagcattgttaataatatgcttcatggaggaaagtttaagaaagcaatcttaattggtgcggaaaaactaacccggttgctagattggacggaccgtagtacagccgttttgttcggtgacgcagcggctggtattttggctgaaaatgattcttcgaactcttcatatttaatcaacgaaaaattgaatacatatgggaatatgggccagtatctaacggctggaaacgtagcagccttagatgacccagcacaatcgtatttcttccaaatgaacggtcgtaaagtttacgaatttgccactaaacgagttcctgaatcaattttgacagttcttcatgaagcgaacattgatcctagtgaggtaaagtatttcttacttcatcaagcaaatgaacgtattgttaaaagcgttgcgaaaaagttagatctatcaatggataaatttccagtcaatattggtcgcttcggtaacaccgcagcagccagtgaatccgtcttgttagcagaaatgttagcagatggaaaaattaatcgcggtgacattatcgtcttcagcggctttggcgggggcttaaccgtcggaacaaatgttatcaaatattaaaaaaataaattaaattatattctcggaggaataatattatgactaaagaagaagtattcacaaaggtacaagcagtaatcgcagaacaattggaaaaagacgcagacaagatcactatggaaacaagtttttcagaagacttggacgctgatagcttagacatttttgaagttgttgacaagttagaagacgaatttgatatcgatattgatacagacgaaaatatgaatactgttggcaagttagttgattacgttagcgaaaacatcgataagtaattaaaaaggggtaaatgatggttaaagcggcttatttatttagcggacaaggacaacaatttgaagggatgggaatggatctgtatcaaacagagccggcctatcgagcattagttgatgaagctagtcaaattttaggtcaaagttttgctaaacaagatgttattgataatgaagaaaatttacaattatcaattgttattttgagtttaggaattgcacgaattcttagcagtgaaaagattgcaccgcagaagttcttggggcttagcttaggtgaatattccgctttgattgccgcaaatggtttttcaattgatgaaggtttaaaagttcttgaagatcgttcaaaatacatggctgaagcagggaaactaaatccaggccaaatggtagcagttttaaatgccagtgatgatgtgatgaacgaggcaatgcatgctgctcgagagtttggtaaagtttatccagcaaattacaacacacctaagcaaacggttttcggtggcgatgctgctggaatcaacaagtttagtacactgttaaaagctgctggagttaagcgggttgttccaattaagatgagtgtggcatcacacacaccatttatgcaaatggctagtgataacttgaagacccgtttggaaaatgtcacagtagctcaaccgaatgtgccagtaattagcaatacgatcaagactgaatttactaaagctaatactaaacaaacccttgcagaccagttggtaaacccaacttatttcacggattgtttagctgtaattgaggcagatccaatcgattgtttggtagaaattggtcctggtaaagcgcttagtggatttgctaaaaaaactctcaagaacaaagacttaccaattttcaatgtttatgatgttgaaacactacaaaaattacggaactatctttcaaatcaggagggctaattaagtgattattaaagatacagtggcagttgttactggtggaactcaaggaatcggattagcaatcgcaatggatttagctaagaaaggttcaaaggtttttatcactgctcgccatgatatttcggatgatgcagtaaaagaacaaattcaaggacttgatatcaactttaaagaacttgacattcgtgatgatgcaaagattggcgaattgttaaacgacattaaagaagaatttggtcacttagatattattgtgaataatgctggaattacaaaagataagttactaagtcgaatgtcagttgaagattttaatgacgtaattgcaactaacttagttggtgcattttcaatgacaaaatatgccatgaaaattatgcaaaaacaacgttcaggtaacattgtcaatatctcaagtatttcgggaactcaaggaaatgttggacaagctaactattcagcaagtaaagctggaattgttggtctaacaaaaactacagctcgtgaaggtcttttgagaaatattagatgtaatgctgtggctccagggatgattgaaacagccatgactggaaaattaagtgaaaaggttcgtgaaaaaacagaagaaatgattccaatgcaccgtttcggtcaaccagaagaaatttcttcaacagtagcctttttacttgaaaatgattatataactggtcaagtacttaccgttgacggtggaatgaccctttaggtttttgaggaggaaaaaatgggtagacgagtagtagtaacaggcatgggagctttgactccccttggaaatgatcgtgaatccttcattcaaggactaaatagttcaaaagttggaatcgataaaattacacattttgatgccgaaccaacaggtatcacggttgccggtgaggttaaagactttgatccaactgttagaattgagagaaaaattgcgaaacgaatggatgcattttctcaatatgctctatattctgctgttgaagcaatggaacaagctgattttaaagaaggcgagttagatccttaccaagtcggtgtaatttatggttcagggattggtggattaactaccatccaagaacaagtcattaaaatggatcataaaggaccgagacgggtttcaccattatttgtaactaactcaattactaacatggcagctgggaacatttcaatgtatttcaatgcaaaaaataccagtcaagcaatcgttactgcttgtgctagcgcaaataatgcaattggaaatgcattccaccatatcaaaaatggttacgcagatgttatgattacaggtggttcagaatcatcaattaatgaaattggaatcgctggtttcgcttcattaactgcattaactgcatcagaagatcgtttacgtgcctcaattccatttgataaggatcgcaatggttttgtaatgggtgaaggagcagctactttaatccttgaagactacgaccatgctaaagcacgtggtgctaatattttagctgaaatcgttggttacggtatgacaagtgatgctttccatatgacccaaccagatcctgaaggtcgcggtgccattcgtgcaatgcaaatggcaatggacgaaggtggcattaaagccaatgatattgattatatcaatgctcatggtaccagtacgcatgctaacgatagtgcagaatcaaaagctatcgaaagcatctttactgaaaacgaccattataaggtaagtagtactaagtcaatgactggtcatttgcttggtgcggctggagcaattgaagctgttgcaactattgcagcacttcaaaatggtattatgccagttaacgtaggtttagaaactaaagaccctgaagttaacattccattagttacagaagataaccgtaaggcttctgttaactatgccttgagtaattcatttggttttggtggacataacgctgtattagcatttaagaggtgaaaatgttgactgaaatagatttagaaaagttattaaccaaattagataaatcatcattcacgtcattcgaaatgacggaaggtgattttagcattaaagtaaaaaaagaaactactcaagtagttcaaccagtagcaacggttaatgccgttgctactgacgttgaagcaacttctgaaatagcggatgctaacctagaagagattaaggctccgttcgtgggggtggtctattttgcaccttcagaaggagaagatccttatattaaggttggcagtcacatttcaaaaggcgatactgtgggcttaatcgaagccatgaagatgtttaatgaagttcattcaccagttgatggtgaagtcgtagaactcttagttgaaaatggatcgatggttgaatatgatcaaccaattgcccgtgttcgtaaagttggagataattaatggaaattaatgttcaagatattattcctcaacgtcctccttttcaaatgattgatcaattagttgatcttgaagcaggaaaaaaggcggtcgctgaaaagaaagttaccatcaatgaatggttttttaataatggcaacgagctctgcatgcctgagccactcttagtcgaggccttagcacaaacgggagcttgtgcacttttatcaaacgaagaatttgttggaaaaaatgctttctttggcggaattaaacaagctgaattttcaaatagagttgttcctggcaatcgacttactttaacggttgaattaaccaaaatgaaaagacaaattggtactggtcatggggttattgttaatgaaaataacgaactgatctgtgaagctgatttaactttcattgtgggctaggaacagggaggctatctatgtttcaaaaggttttagttgctaatcgtggtgaaatcgcggtccaaattatccgtgccttacacgaaatggatattgctgcagttagtgtctattctacagctgatgagaatagtttattcgttaaattagcggatgaagccgtctgcattggagggcctcaacctgctgattcatatttaaacatgtttaatattatcagtgctgccgtcttaactggctgtgacgcgattcatccaggttacggatttttatccgaaaatgcggaattcgctcgtttatgtaaagaaagcaatctggtatttattggaccgcactataaaaccattgacttgatgggaaataagtctcgagcgcgtgagacgatgattagtgcgaatgttccggttattccgggaagcaacggcatggttcgcgatttagagaatgccatggtggtggctaagcaaattggttatccaattatgcttaaagctgctgatggtggtggcggaaaagggattcgtcgaattaattcgtcagaagaccttaagaaagcttatcaagaagcgaagcgggaagctgaaacttcttttggtaattctgatttatatattgaaaaaatcattgaaaatgctaaacatattgaaatgcaagttattgcagaccagtttggtcattatgtatttttacctgaacgtgattgttcgctgcaacgaaataaccagaaagtaattgaagaaacgccatgcgccactatttcacattctgaacgcgaaagtttaggtgatattgtagttcgggctgcaaaggccatcaattattataatactggtacaattgagtttttgatggatgaaaatcataatttttatttcatggaaatgaatactcgacttcaagttgagcatacagttactgaagaggtaacgggaattgaattaatcaaagaacaaattaagattgctgaaggattgaaacttgatttcagccaagcagacgttgaaattttaggccatgcaattgaatgtcgaattaatgccgaagacccaagcaatggttttatgccatcggcggggaccattaagcatctatttttcccagatggaacaatgggtgtacgcattgattcgggaattacatatggtagcatgatcccaccattttacgattcaatgatttcaaaaataattgttaaaatgccaaatcgggttcaagcgactagaaaaatgcgtcgtgttttagatgaatttgaaatcgaaggtgtaacttcaaataaggcattcttagaggctttactagttgataagggatttgaacaaggattgtttacgactaaatatattgaaaatgtctttttgaaagagtggttaagtaatgcaaaataaattctcacttcctactcaagatgaaattgttaagcgattgaagaaaattccagaaggtttgtggcgcgaatgttctaattgtcacgaaaagttttattaccgtcgcgcagggatttatgaagtgtgtcctaattgtgggtatggtgcacggctaggttctcgtaaacgaatcaaattactttgtgatgagtttgaagaatgggacaaagcaatggctactgatcctactaatatagacgatgaaaagtacaaaaagaaactggctacagggattaaaacgactcacgttaatgaaagtgtcctcacaggaaaagctaaaattggtaacaatgaatttgctattggagtgatggattcacgctttatcatgggtagtttaggtcaagtgacgggaagtaaaattgcacgaatgttccaggaagcgactcggcaacatctaccagttattatgtttactgcttcaggtggagcgcgaatgcaagacggaattcattcgttaatgcaaatggctagggtttctgatgaagttgctcgtcatagtgcggaaggcttattatacattgcagttataaccgatcctactacaggtggagttacagctagttatgccatgcaagctgatattattatttcagaaccaaaaacattaattggttttgccggtcgccgagtgattgaacaaacgattaatcagaagccacctaaggattttcaacaagccgaaacgttacttaaaaatggattcttagatgatattgttgaacgaccaaatttaaaagaatatttgaataatcttttaaatttacattcagataagtaagtagggataaaaaatggcaaaaacagcatatgaaacagtgactgctgctcgcagtaaggataaagttgcaactgctgatttgataaataatattttctcgaattttacggaactccatggagatcgtcaattaagtgatgatcctgctgtgattggtggaatcgctctattgaacggtacaccagtaaccgtaattggtacccaaaaaggtaaaaataccgctgaaaatattgaacgtcattttggaactgttgaacctgaagggtatcgaaaagcagtacgtctaatgcaacaagctgaaaaatttaaacgaccagtaattacatttgttaacacaccaggggcttatccaggaatggatgctgagtatcatggtcaaggttcagcaattgctaacagtttaatagtggggatggaacttcgtgtcccttatatcagtattattgttggtgaaggtggtagcggaggtgcattggctctggctaccagtgatacagtttggatgatggaaaatagtatctattcagttttatcacctgaaggttatgcttcaatcgtttggaaggattctaaacgtgttattgaagcttctgaggctttaaaattaactccagaacatttacttgaagatggaattatcgataaaattgttccagaagttgttgatcaaactagtacacaaaatttaaaacaaatgttagttacagaagtaaatcgtttaagtcaattttcagctgatgaactcgtgcagcgacgacatgaacgatttagtaaattctagaagaggggttatgcagttggaaggaattcttagtggaaaaaccattgtcattatgggtgtagcgaataagaacagtattgcttggggttgtacaaaagcaatcatggatcaaggcgcaaaagttgtattaacttaccaaaatgaccggataaaaaaaagtttaaataaaattgtggatgattcaatcgcattggttgaatgtgatgtttcagaagatgccaatattgaaaaggcctttaaacaaattgaagataaatttggtaaggttgatggtattattcatgcgattgcctttgctgacaaggaaactcttgaaggtggcgttttaaataccaaaaaagaaggttacaatctagctcaagatgttagtgcttactcattgattgctgtttcacgctatggtgcggaaatcatgaacgaaaaaggtagtattgtgacgcttacatacttcggctcaactcgtgcaattcctaactacaacatgatgggaattgctaaagcttcacttgaatccagcgtacgctacttggcaagtgatttaggtgaccgtcatattcgagttaatgctatttcagctggtgcaattaagacacttgctgttacaggtatcaagcatcatcgtgacttgcttaaagaatctcaaagccgtacagtcgatggtgaaaatgtaagtactagtgaagttggaaatgtcgctgcattccttgttagtgatatggcaactggtgtaaccggtgatgttatttacgttgataaaggcgtacatttaatttaagctaaataaaaagattaaggtggttaccttaatctttttttgtatcctcaaattgtcagatatagatagattttttgagaaattgactagatgtaattgcgtttattaaaattaaatgatattattctaataataagtgaaatggaggttgttatatgaatcatcaagttaaatattttgctaatgttaatgtaacaaccactacctcaaccaccatcctgtctggttgagtgttttgaggtgctttccaattaaaatttggttaacaaacaaaaccacccaatcagaattcagtgcctactagcattgatactgattcggtggttttttatattttgaggaggaagaacaatgaaggaagatttaccgcagttaaaacgatcacttacatcaaaccaaatgcaaatgattgcattaggaggaaccattggtgtgggattattcatgggatcctcatcgacaattaagtggacgggaccatcagtgttgctagcatatggctttgcggggttaatattgtacctagttatgcgtgctttaggggagattttatatgtaaacccaagcaccggttcctttgctgattatgcaaccaactatattcaccccttagcaggatatttaaccatgtggagcaatatcttccaatttattgtagttgggattagcgaagtggttgcagttagtcaatatttgaattactggtggccaaatttaccagggtgggtttctagtgtggtggtaattgctactttaacgcttgctaacttggtttctactaaagcatacggagcgattgaattctattttgctttaattaaagtgctaacgattattttaattattattattggtgttttagtgattttcatgggcttaggtaatcattggcgccctgtaggattgagcaatctttgggctcacgggggctttttcacaggtggagttaaaggattcttgtttgcgttatcaatcgttgtaggctcttaccaaggaattgagttacttggtatcactgctggtgaagcagctaaccctaaaaaggccattgttgcttcggtaaaatcaattgtttggcgaattttaattttttatttaggagcaatctttgttatcgtagctatttttccttggaatcaattggctacggtaggttctccgtttgtggaaactttttcaaaagtaggaattaccggagcggctggaattatcaattttgttgttttaactgcggcaatgtcaggaaccaattctggaatttatagtgctagtcgaatgttgtataaactatctcaagaaggaaaggtacctaagatttttggtaaattatccagtcatcgagttccatctgtagcaatcttgaccatatcttttggaattttgttagggattatcttaaatatcttcttatcttcatttaaaggaggagccgttaacctatttgtgctggtatatagctcaagtgtgttgccggggatggttccatggtttgttatcctactttctgaattacgctttcgccgtgctaacccagaaataattcaaaatcatccttttgtaatgccgctttatcccatgagtaattacttagcggttttctcgttgtttttgattgtagtttttatgttcatcaatccagacacgagggcatcagttacagtaggatttgtttttctaatggttttaacgattaattttataattaaattccgccgtaaacggggctagaaaaaattcagaaagctaaagttctgaagcttttaatattttaaaggaaaagatattgctaaggtttacctaagaaataagctgaactttgataaacagataggggtctgctaaaatttaatagataaaaaattcaggattaagctttggaggattggttttgaaaattggaattgataaaatgagcttttttacgagtgatttatatttaccgatggaggatcttgcaaaggctcgtaatgaagacccaaataaatacttgattggtattggacaatcaaaacaagctgtaatccgaaattcacaagattcagtaacactagcagctaatgcagcattaaaaatagtagatgataacgaaaaagaaaaaatcgatttgattttattcggcactgaatctggtgtagataactctaaatcaggagcaatctacttacagtcattattgggaattaactcatcagcgagtggtgttgagctaaagcaggcttgttttggtttgactgctggaattcaaatggcaatgggacatattgctttacatccggaaagtcgagttttactagtaggatcggatattgctcgctatggaattggtacattaggagaaaaaactcaaggtggaggagcagtcgcgataattatgagcgctaatcctcatctccttgaaattggaacgcaaagtgcccatttaactaaggatattatggatttttggcgtccattaaatcgtagtgaagcgttagttgatggtaagtattcatcagccgaatttattaatttcttcaaagaaactttcgaaaattacctcgaaaaaacgggcgaagagattgataaatttaccgctcttgtttttcatttaccttacactaagatggggcttaaagctttaagaagcgtaattgaagacctagataatgatgatttaaaagaacgtttattagaacattttgaggagagtcgttatttgaatcgtgaggtaggaaatttatatacaggttcattgtatctgagtctgttgtcattattacatgcccgcaatttaaaagcaggcgaccaaattggcttgtttagttatggttctggtgcagaaggtgagttttattctgctaaagtcgttgaaggatatgaaaggtatgttacagatgaagaaattgcatttttggatcaaagaacttcggtctcagtggctgaatatgaacaaatctatcgtagttttatgaaacctcaaacagcggactacagaactgaatttgaaaacgatcctgcaccatttgttttgaagggacaacaacaacaacaacggatttatgaaaaagtaaattaaaaaaatggcaacttgggtttaaacctaagttgccattttttatgagaagatgctgtaaacaattttaccgtctttcgcgataatcatcgctttatttttgtcaggttgatttaattgaacggcatatcccttaccaagttcttttttgagggattttgaaacctcaacaaatttatcttggatatctttaaaattactattactcatttggtcaggattttcgatcaactgattgaaaacttttttagtgtctttatcggttgctgaaacactaaatgttttggcagatggatcatatgtaacagtaccaaacgatttaaaagatttagtaagactagcctggacttgttgcatctgttgggccttagatgaagaggcaacactttcgcttttaatcatttccaacttatcgtccttcaagctcgattttttactagcaattaaagttgagttggtcttagagccagaacttttatgtgaagtttccatcacatttcttgctgagaaaataacaacagcaagggggataatcactaaaagtgagcttaaaaaaatggagcctcggttcctaattgatgaataaaattgaaaaaatccaagtaataatgtaattgatgctaaaactaaaacgtaaagcatagtaaccctccaaaatgatttatcgcattaacaatagtatgctttgaaaaacataataaatcaataggaaagtcacatctagtagatgttatctctaaataaaccaacaactttaccgaggatagtcacgttgtccaaaataattggggccatcgtatcattttctggttgaagtcgaatgtgatcggattctcgatagaatcgtttgcaagttgcttcattttcatcagtcatagcaattacaatggtgccattgtcggctgtagattgttttctaacaataacttgatcaccagataaaataccggcattaatcatactttctcctcggatggtaagcatgaacaaattactactatcattttcgtactctggaggaacagggaagaaatctgtagcttcttcaacagccaaaattggttcaccggcagtaactactcccagtaagggaatagtaggatttttatcttgtactcctaaagcgtctaaacctaattttgttacctctagggctcggggcttagtaggatccttttctaaaaagccgtttttttgtaaacgatcaatgtgtccatgaacagtggaagtagatgatagtccaatggcactaccaatttcacgcactgtagggggatatccttgagcgttaactgttttataaatatattccagaacgctgagttgcttagtgctgatattttttgccattttttcacctcataaatatttgttgttattttatcataaaaaatcctaatactcaaacaaatgttcgctttaaaaattgaaattataagctttccatagtatgattaagctactaataacggagggatttattatggccgatcaagaaatgcaaaaattaattaagagaatcaatgaacttgctaaaaaagcaaaagaagaaggacttagtgacttagagattatcgagcgaaaagatctgcgtcaaaaatatttgaagaagttccgagagagtttcagaagtcaagttgaaatgatgcaaatttttgataaagaaggcaaagaagtcacacctgaaaaggtaaaagaagttcaacgaaaaaagggcttacgtgacgattagaacggggcttttgtttttagccgtttttgtgtaaaatgaataggtaagtcgttggtaaggaggattgtaaatgtcaactggaatttggattatgattgtaatcatcgcattgcttgttggtgcagttggtggtttcttctttgctcgtcgttacatggagaattatttgaagaataaccccccaattaacgaggatatgcttagaacaatgatgcttcagatgggtcaaaagccatcacaaaagaagctccatcaaatgatgactgcgatgcaaaatcaatctaagaaataaaaaaacgtccattatttggacgctttttttgtttctttattcgaaatgtcaatgtatttaaacgtaggatcaacctcattatcaagtttaacaaaagcattgtttaattcttcttctagcattgctaagttttcgtcattcatttttgttttacgatcaatagtaatcggttcactaaagttgatatgaatcttttgacgagtaaatagtcctttaaaggttaatggtccttgataaatagctggtacaatgggggcgttagctaatttggcaattacgaaagcaccatttttaagctcttgggaatgtcgagttcctgaaggaaaaataatggttgataattctcccttttttaaaatcttaaccggggttttaatggctgaaggacccggattttgacgatcaacaggaaaagcatttaatttagtaattaaccagcttaaaaaccgattttgaaagagttcctttttagccataaaagaaaatctttgcggataagcagctagggcatatagcactggatcaaaccacgtgcggtggggagctactaacacataactaccttctggtaaacgttctgagttgtgtacatcaggtttcccattaataagaaatatcaatgaagaaacaaagtgtttaataaatgaataaaacataagataacctgtactttcatatatttattaatttgattatattatgaagtattggtaaagaaaaggagttttaaatgcaagttgagttaaaaagtgacgagcgaattgatcaattatatcgcgatgatattcagattattcaaagtccatcagtattttcattctcactcgatgcggtattattagccaattttgctgaggttaaaaaggctagtaagactaaaattgtcgatctttgctctggaaatggagcagtgggtttatttctttcaaaaaagactgccggctatgtgacaatgattgagattcagtcacgattagcagagatggcaatgcggagtattcagttgaacgatttaactgaccgttatgatgtttacaacatgccgttgaaagatgcgttaacgaaaattaatgctgattccatagataacattgtttgtaatccaccttactttgaagatttacctagtagcaagaaaaatcccaatgaacatttggcacttgctcggcatgaattaacgacttcattagaggaagttcttcaggtgagtcaaaagatgttaaaaatgaatggaaaattatttttggtacatagaccggatcgactacctgaaattttaaccaaattagttaaaaatcgattggcacctaaacgaattcaatttgcacattctcacgcaggagatgaagctaatatggttttaatcgaagcgattaaagacggtaagcctaatggaactagaatcttaccaccaatagttatttatgaggggttggaatactctaaagcaattaaggagttattatatggaaatcccactgactaacggattttatttttatgttttacgctgtgcggataacactttatatggtggctataccataaatcttattaaccgcgttgaacgccataataagggacaaggtgccaaatatactaaggctcgaagaccagttcaattaatttattttgaatcgtttgataatcagcatgacgcaatgtctgcagaatatcagttcaagcaacgaacgcgaagtagtaaaattaaatttcttaaaaagaacggtatttcattaacaaatttaaaataatagtggtacagttaaggcgattaacgactaatttaatagtttgaatactgtaatattttttgaatcatgatacagtatgtaaaacaaattatttagccaagtctgagaggagaatttttgatgaaaattattgcttatggcattcgagatgacgaaaaaccttacctagaagaatgggttaaagataataaaattgaagtaaaggctgttagcgaattgttggactctaacacaattgaacaagctaagggttatgacggagttgttgcatatcaacagaaaccttatacagatgatttgttcgataaaatgaatgaattcgggattcatgccttttcgcttcgtaacgttggtgttgataatgttccagttgaggctttaaagcgaaataatattaagattaccaatgttccagcgtactctccaatggcgattgcagaactttcagtaacccaactcctagctttaattcgtcgaattccagaatttgatgttaagatggctcgtggtgatttcagatgggaaccagatattgctctagaacttaacaaaatgacagtgggagttattggtaccggaagaattgggcgtgcggccattaatatctttaaaggctttggagctaaagtgattgcttatgatgttttccgaaattcagaacttgaaaaagaaggaatctatgttgactcgcttgaagaactttatcgtcaagtagatgttattaccttacatgttcccgctttaaaagataactaccatatgttaaatgatgaagcgttcgcacagatgcatgatggggtatttgttctaaattttgctcgcggtagcttgattgacacgaaggcattacttaaggctttagatagtggtaaggtggctggtgcggcactagatacctatgaagacgaagtaggtatttttgatgtggatcaccaaaatgacccaatcaatgatcccgtatttaatgatttatacagtagacgtaatgtaaaaatcacaccacatgcggctttttatactaagccagcagttaaaaatatggtacaaattgctcttgaaaataataaagcactaattgaaaaaggtgctgcaaaaaatgaagttaagtttgactaatatttagcttgaaatgcgactttagttaggttaaaattatattcggcctgtaggtcaaaaacacacttgattggaagttgacggagtgctcaactagtttgagtcccgaaaccgtagataatcaaggaggaaaaactaggaggaaaataacatgtctgttatttctatgaaacaattgcttgaagctggtgtacatttcggacaccaaacacgtcgctggaaccctaagatgaagccatttatctttactgaacgtaatggtatttacatcattgatttacaaaaaactgttaaattaattgacaatgcatataacttcgttaaagatgttgctgcaaatgatggtgtagttctttttgttggtacaaagaagcaagcacaaactgctatcgaagaagaagcaaaacgtgctggtcaatactttgttaaccatcgttggttaggtggaactcttacaaactggaacacaatccaaaaacgtatcaagcgtttgaaagatttgaaagcaatggaagaagacggtacatttgatcgtctacctaagaaagaagttgctcttttgaacaagcaaaaagacaagcttgaaaaattcttgggtggtatcgaagatatgcctcatactccagacgtattgtttgttgttgatcctcgtaaggaacaaattgctatcaaggaagctcaaaaattgaatattcctgttgtagctatggtcgacacaaactctgatccagatcaagttgatgttattatcccatcaaatgatgatgctattcgtgccgttcgtttaatcactgctaagatggctgacgctgttatcgaaggtcgccaaggtgaggacgaagaagaagcttcacaagaagtcgctgaaggcgtaagcaaggactctcttgaagacttgaagaagtctgttgaagaaggaagcaacgaagaataattatcacttaggctgtcgtgatttgagaccttttaggcctgagattacgcgcggcctttttttacggaatcacaaattggtattagtaatataaaaagctaagggggccataaaaatggcaagtatttcagctaaattagtaaaagaattacgcgataaaatcggtgttggtatgatggacgctaaaaaagcacttgttgctacagaaggtgacatggacaaagcagttgattttctccgtgaaaaaggtattgcaaaggctgctaagaagagtgaccgtgttgctgctgaaggtcttgcagatgttgaaatgcatgacaacacagctgcaattgtagaagttaattcagaaactgactttgttgcatcaaacgatcgtttcatcgacttagttaaggaaattgcttcacaagttgcacttgaaaaacctgcagatgttgatgctgctcttaaattgaagtcaccaaagggtactttgaatgatgatatcatcgaagcaactcaagtaattggtgaaaagatttctcttcgtcgctttgctactttagaaaagggtgaaaacgaacatttcggttcatatcttcacatgggtggtaaaattgcagcgcttgtattgcttgaaggtgctgatgaagaaactgctaaagacgttgctatgcacgttgcagctatcaaccctaagtatgttaaccgtgaccaagtacccgctgaggtattggaccacgaacgtgaagtacttagcaaagaagctgaaggtgaaggcaaaccagctaatatcatcgaaaagatggttactggtcgtttgaacaagttcttggctgaaattagtttagatgatcaagaatatgttaaagatcctgaccaaacagttgctaaatatgttgcttcaaagggtggtaaagttaagtcatttatccgctttgaagttggtgaaggtatcgaaaaacaaactgttgactttgctgaagaagttcgtaaggaaatgggccaataaaacccagagtttttggatatttaaaaagcgaattaatatgagtttagctcaattaattcgcttttttgtaggattttacacgtaataacagtgtggtttgccgcatttttatgatagaattaatgaaggaaattaaacataggaggccgtaatatgtcggaagttaaatacaagcgagtaataatgaagctgagtggtgaagcacttgctggagataaaggaacaggtattaatccaccagtaattcaaaaggttgctgaagaacttcgtgacgtgcatgacctaggagtacaaattgccatcgttgttggtggtgggaacatgtggcgtggagaaactggtgaacagcttggaatggaacgtgttcaagctgactatattggtatgctaggtacggttatgaatgctttagcacttcaagatagcctagaatcactaggagttccaactcgcgttcaaacttccattgaaatgcgtcaaatcgctgaaccttacattcgtcgtaaggccgttcgtcatcttgaaaagaatcgcatagtaatctttgctgctggtacaggtagcccatacttctcaactgatacaacttcagctttaagagcggctgaaattggggcggaagcaattttaatggctaaaaacggcgtagatggtatttattctgccgatccaaacgtagaccctgatgcagttaaatttgacgaattaacacatatggatattattgataaaggacttaatgttatggacactactgcaagttcactttcgatggagaataatattccattagttgttttcaacttaaaccaagcaggtaacattaaaaaggttgttgcaggtgaaaatattggaacaacggttagaggagaagaataatggcaaaaaatgagataatccaaaaagctgaagaaaaaatgcaaaaggcacagaatgttttagaacgtgatctaggttcaatccgtgctggccgtgctaatgcttcattacttgataaagtttcagtggattattatggagctccaactccacttaatcaaatggcttcaattagcattccggaaccacgagtattattagttactccttatgataagagcgtattgaacgacattgaacaagctattttaatgtcagatctagggattaatcctgctaatgatggctcagcaattcgtttagtagttcctcaattaactgaagaaactcgtaaagatttagccaagaatgttaaagcagaaggcgaaaaagctaaagtagcagttcgtaatattcgtcgtgatgcaatggacactttgaaaaaggctaataaaaatggcgactacaatgatgatgaattccatgatttagaaaaacaaactcaagatagtacggataaagcaattaaagttgtagacgaaatcgtagctaataaggaaaaagaagtccttgaaggctagtattaacttttgataaagcaccccaagaattgtagtgaaaactcaacttttggggtgctttactggttattgcaaaattccaacttcaaccaaaaagtatcaaaatttggtatggtacaataaaaatcatgtgtttttaggtagttttgaagatgtttgacgtatctttaatagtcgttgtccgtttatttgtacagaacaatgattttgtagcttttttttggtaaaataataaccattagcttggaggttttttgatgaaaatgaatcaaaaacttgaaacagaattaaatgaaaatattccaaagcatgttgccattattatggatggtaacggacgctgggctcagaaacgatttatgccacgtgttgctggtcataagcgaggaatggaagtcgttaagactattactaaaagtgctagtaagttgggcgtaaaggtgttaaccttatacgctttttcgacggaaaattggaaacgtccccaagatgaagtttcattcttaatgaaattaccgattacttttttcaataaatttgttccagaattgattgaagagggggtccaggttcgagtaactggagatattgacggccttccccaagcgactcaagatgctgtacgaaaagcgatcaaggataccgcacaaggtacaaagatgattttaaattttgctcttaactatggaagtcgggacgaaattaccaagatggtccagtcaattgctcaagctgttaataccaaacaattggacgtggataaaattgatgagcaggttattgaaaaccatctacaaactaattttttaggcgaactttctaatccagatgtattgattaggaccagtggagaagagcgaatttcgaacttcttactttggcaaattgcatatagtgagttagtctttactgacacactttggccagatttcgacgaaaaaatctttattgaaatgataaaagagtatcaaaaacgtgatcgacgttttggtgcaattaaaaagtgaggaattaattttgaagcaaagagtaattactgccgtagtagcgttaataatttttattccaattgtctttcttggaggaacattaatcgagattgcagccttggccctggccgtgatggcaatgagtgaagttttaattatgaaacgaattttgttggtgactcctgaagcaatcattagtatcttaggaacgttattcttggttgcccctaagtcatggatgcacgacttaccgagccaaattaatacaccattcgtttctttgatttttgccattgcgttaatggtgagagttgttttcagtaaaaatcgttttaatttcgatgatgctggtgtgctaacattgacgatgctatacattggattcggatttaatatgtttgttcaagctcgaacggtgggcttaggaatgttaatgtatctgctactaaccgtttggagtacagacagtggagcctacttagtcggaagaaagattggtaagactaaacttgctcctcaaattagccccaataagacttgggaaggttccattggcggaaccgtagttgcaattattgttggaattattttctcagtaacgggactaatccattttggaattctagctacaattttaatgacgctattcctttcaattgcaggtcagttaggagacttagtagaatcttctcttaaacgttattacggtgttaaagattctggtcgtatcttaccaggtcatggaggaatccttgaccgttttgatagtctattgctagtattgccaatggcatatttattaggtttactataaaatttgccagttaggagttatttatgataactacgattattacctttattgttgtatttttaattttagttgttgtccatgagtatgggcattttgttgctgctaaaaagtccggtattttagttcgtgaattttcaattgggatgggtcctaaaattgttgatttgaagcgtaatggaactacgtatactttacggattcttcccattggtggttatgttcgaatggcggggctcgatgaacaagaagatgaattgaaagcgggacaacatgttacattaaccacggataatactggacaagtgacgattattaatacttctagtaaagttcaaaatttgatgggcattccagttgatgtaaccagttttgacttacaagataaattattcattgaaggttatgaaaatggtaacgaagacgaagttaaacattttgaaattgatcatgatgcatcgatagtcgaatccgacgggaccgaagttcgaattgcaccgcgtgatgttcaatttcaatctgctaagatttggcagcgactaattactaattttgctggaccattcaataattttgttttggccatcgttgtttttgcgataatgggagttatgcagggagcagttccggctaatactaaccaagtacaagtcgttgaaaatggtgttgctcaaaaagcaggaattaaaaataatgatcgtattgttagagttgaaggacaaaaaacagataattggagtcaactatctaaggcagtttcagctcgtccaaatcaaaaaacgactttagaagtattacgtcaaaagcaaacaaagaaaatcacattaacacctaagttagcaagtaatggtagtaaaaaagtgggtatgatcggtgttcaatcatccatgacaactaatttaggtaagcgagttttatatggtttcactggaacttggcaaatggctaagagtttgtttaccgctttaggacagatgctacatggctttagtttgaatgatttaggcggtcctgttgcaatttatgccacgacctctcaagctacccatcaaggcttcatgtcagtgctgtatgtgcttggttttctatccctaaacttggggattgttaacttattaccaattccagctttggatggaggaaaaattctcctaaatctcgttgaaatgattcgaagaaaacctttaaaagttgaaaccgaaaatgtgattacgctaattggctttggatttttaatgatattaatgctgttagttacttggaatgatattcaaagatactttttttaaattaacttaaggagttcaaattcaattatgaaacaatcaaaaattcttattcctactgtaaaggaagtcccaaatgatgccgaagttttaagtcataaaatgatgcttcgggcaggatacatccgtcaaatttcggccggaatgtatgcatacttaccattagcttataaagtgattagtaagattgaaaaaatcgtgcgtgaagaaatggaagcaatcgacgccgttgaaatgttaactccagcggttttaccagctgaattatggaagcaatcaggccgttatgaaacatatggtcaagaactctataaatttaagaatcgtcatgatcgtgattttattcttggaccaacacacgaagaaaccatgactacattgattcgagacgaagttaaatcatacaagaaacttccactttctttataccaaatccaaatgaaatatcgcgatgaagatcgtcctcgttatggattactacgcggccgtgaatttttaatgaaagatgcttattctttccacgccgatgaagaaacgttagaccaaagtttccgtgatttcgaaaaagcttaccaaaacatttttagacgttgtggtcttaacttccgtgaaatcgtgggtgacgccggagcaatgggtggtcgagattccaaagaattttcagctattgcttctattggtgaagatacaatcgcttactcagaagaaagcgattatgctgctaacttagaaatggcaagtagtgtctacacagatcttcaaatgcatgaaaatcaagaagaacttactaaagtggctactgatgatgcgcattcaattgatgaagttgctgctaagctagatgtggatagcaaccgtttaattaaaactatggctttaattgtcgatgaagcacctgttttggctttactacgtggtaatgatcaactaaatgaagttaagcttacaaatcttttgcacgctgatgaggttcgagaagcaacggaggaagaagcgtttgaacttctaggtgcgcacgtgggttcgcttggtccagtacttgaaaacaaaccagaaaatttaaagattgtagcagataaatatattgaacaaatggttaacagcgttgttggtgctaatgaagatggtttccatttgaaaaatgttaatgttgaacgcgattttaccgttgatgaatatgctgatattcgtactgtccgtgaaggcgaacttgctccggatggtaagggtgctttgaaattcactaagggaatcgaaattggtcatatcttcaagattggaacaaagtactctgaagctttggatgctaaggtactagatgaaaacggacgagcaatcccagtaattatgggttgttatggaattggggtgagtcgtttactatcagctgtttctgaacaacaatctgatgaaaatgggcttgtatggcctaagaatattgctccttatgatgtccatgtaattccagttaatgccaagaatgcggaacaaatggaaattgcggaccaaattaacggagaactaactaaagcaggttacgatgtattagtagatgatcgtaaggaacgtgccggagttaagtttgcggattcagacttaattggaatcccacttcgtgttaccattggtaagaaagcttctgaaggcattgttgaagtcaagttacgtaagacaggggaagcagtcgaagttaaggttgcggaactaaataacacggtagaaattttattaaaccaagctcaataaaagtaaataaaccaattaaagctggggaatcccagctttaattatttgtagcaaatatttttaatggattagtaacatcagggggaccaaagagtgagtttgtcagaaaatgaacaattcagagttttattagagcaaattgatttgttggataatgctgaattaaaagatggttcaatcaaagatttaactgtgcactccaattccaagcgttggacgtttagttttgagtttaatgatattttacctttacaagtctttgttgaatttcatcatcaattggttaatacgtttggggcaatagctcaaattgatttttcaattgatactataaataaaaataatgttgcaacccatgcaaccgattattgggattggattattaagaatagtggtattcaatcatcacttctacaagtgttatgtgataagtcaattccagagtttaaagatggacaattagttgtcaaagtagataatcaaattactaagaactttctcaatgacgatgttttgcagactcttagtaatacgtatcaaaaagttggttttggtccgattaaaattaaacctacaatcgatgacaatactgctcaagaacgtttgcaagcttatcatgaagaaaaaattaaacgtgatcaagccattgttcaaaaagcgactgaagcaattaaaaaagctgaaagtaaaaagaaagcttctgataaagcgatgcctgaatttaatggtaaagtgcaaatgggtaaaccaattaatggtaaggacaatattattcagttgagagatattacccaagaagaacgttcggtgtccattgaagggtatatttttgacgcagaagttaagacccttcgttcggagcgtcaacttttaatctttaaggtaacggactatacatcgtctattaccatcaagaagttttctcgtaatgagaccgatgaacaattattctcggccattaaaaaaggtttgtgggttagagttcgcggaagtattcaagaagatagttttatgaaagatctaacgatgaatgcttacgatatcatggaagtcgaccacgctgatcgacaagatacagcaactgataaaagagttgaattacacatacacactaatatgagtacgatggatgctactaacggaattagcgatttggtaggacaagctgctaagtgggggcatccggcggttgcagtcacagatcacgctggattacaagctttccctgaagcccatgcagctggtaaaaaaaatggtattaaaacacttttcggtgttgaagctaatctagttgatgatggagttccaattggctataacagtgaacatcgcccattgaagggcggcaaatatgtaatctttgatgtggaaactacgggtttgtctgcaatttatgacaaggtgattgaactatcggcggtcaaaatggaaaatggaaatgtaattgatcagttcgaagaatttattgatccaggttttcctctttcggaaactacaattaatctgactagtatcacggacgaaatggtacgtggttcaatgtctgaaaaagaagttttcaccaaatttagagaattttatgaagatgctattattgtgggacataatgtaacttttgatattggttttatgaatacaggttacctccgacatggaatggaagaaataaaaaatcccataattgatactttaacgttagcgcggttcttgtatcctactctgaaaggttatcgtttaaacactttggctaaaaaatttggggtagtactcgaacatcatcatcgggctatctatgattcagaaactacaggacatttgtgttatctcttcttaaaagatgccgaagaacgttatgggattgaatatcatgatcaactaaatgatcacatgactgaaaatgaagcatataaacatgcacggccaagtcatgccattttaattgctaagacccaagcaggtttaaaaaatctttttaaattagtatcaatgtcaaatgtcaaatattactatcgtgtacctcgaattcctcgctctgagttagaaaaattacgcgaggggattattgtcggttctgcttgttctagcggggatgtttttacgtcgatgatgcaaaaaggatatgctgatgcacggcgaaaggctaaattctatgattacttggaagtaatgcctaaaccggtttatcaaccattaatcgaacaagaattagttagtgataataagaagttagaggaaatcattgccaatattgttaaattaggtgaggatctagatattccagtggtcgcaacgggagatgttcattatctcaatccgcaagattatatctaccgtaagattttaattaattcgcaaggtggggctaatcctttaaatcgttcagaattacctgatgttcattttagaactaccgatgaaatgctggaagacttttctttcttgggtccagaagtagcacacaagattgttgtcgaaaattcgaataaaatcgctgatagtgtagatgacggaattagcccagttaaagataagttgtatacacctaaaatgccaggtgctgaagaccgaatcaaacagctttcgatggatcgggcacatgctttgtacggtgaagtattaccggaaattgttcaagaacgattaaataaagaattgactagtatcattggaaatggtttctccgtaatttatctaattgctcagcgcctagtgcataagagtaataaagatggttatttagttgggtcgcgtggatcagttggttctagttttgttgctacaatgtctggaattacagaagttaatccattaccgcctcattatcgatgccctaagtgtcaatattcattcttctataccaagggtgaatatggttctggatatgaccttccagataaagaatgtccggaatgtggaacttggatgattggtgatggacaagatattccgtttgaaactttcctaggtttcaaaggagataaggtccccgatattgatttaaatttctcgggagattatcaacctattgcgcataattatatgcaagttttatttggtaaagataatgtgtttagagctggtacaattggtacggttgctgataaaacagcatttggatatgttaaagcgtacgaaagagatactaatcagcatttgcgcggagccgaaattgaacgtttggctaagggcgcaactggtgttaaacgaacgactggacaacatccggctggaattttgattgttcctgattatatggatgtatatgattttagtcctattcaatatcccgctgatgatcagacggctgcttgggaaacgactcattttgattttcattctatccatgataatattctgaaaatggatattctgggacatgatgatccaacaatgattcgtaagctacaagatttatcaggaattgatccagagaccattccaactgatgaccccggggtgatgaaaattttctctggcccagaagttttaggcgttgatgaaaatcaaattcaatctaaaacaggaactttaggaatccctgagtttggtacgcgatttgtgcgaggaatgttggaagaaacccatccaactagttattcagagcttctccaaatttctggattatcacatggtactgatgtttggttagggaatgccgaagaattgatcaaggcgggtaccgtaactttgaaagaagttattggttgtcgtgataatattatgatggatttaattcattatggtttagattcacagtcctccttccaaattatggagagtgtgcgtaagggaaagggaattccagaaggctatgaagataagatgcgtgcggctaatgttcccgattggtacattgaatcttgtggaaagattaaatatatgttcccacgggcgcatgcttcagcctatgttttaatggccttacgaattgcctactttaaggtttattatccattggtttattacgcagcatatttcacggtacgagcagatgactttgacattgtttcgatggcacgcgggaaagaatccctcaaaaatcgcatgcaagaaattaatgataaaggtaacgatgcgtcgacaaaggaaaaaaatctcctaaccgtgttagaattagctaacgaaatgttagaacgtggttttgaattcaaaatgattgatattgaaaaatcagatgctgaagaatggttaattgaagacaagtccttaattgcaccatttaatgctttaccaggtttaggattgaacgttgctaaacaaatcgtggctgcgcgagcagacaagccattcctttccaaagaagacttgtcaaagcggggacatgtttcgcaaactttaattgatttcatgactgagaacaacgttttatcggagttgccggatgaaaatcagcttagtttattctgatgatttgcaaaaatgcccatataatggtatattcagagtagtaatttgatactcgttaattgagtgagcagcgatgctcgctctttttattggcaaaatataattctggaggttcaagtttgagtaacaatgttattgaaaaggtgacagaattagtccaaccaattactgatcgccataattttgaacttgttgaagttgaatttgtaaaagaaggtcaaggttggttcctaagagtctatattgacaaagttggtggcattaacatcgaagaatgtgccatggtcagtgatgagctaagtgaaattttggacgcgcaagatccagatccaattccacaagcttatttcttagaagtgtcttctccaggggctgaacgacctttaaaaacgaaggaagatcttacgagatcaattggtgaatatatccatatctcactatatgcatcgattaataagcaaaaagttttcgaaggttaccttaaaagctttgaaaatgatgaaattgttttggactatttagataagactagacataaagaacttaaagtaacgtatgatcaggttgcatttgctagattagcaatcaagatttagaggagagtttaaaatgagtaaagaaatgattaccgctcttgatatcttagaaaaagaaaagggaatcaaaaaagaagttatcgttgaagcacttgaagctgcattagtttcggcattcaagcgtaattacggacaggctcaaaacgttgaagtagaatttaatgatcgtaaaggtgatattcatgtttacgccgttaaaaaagttgttgaagaagttgaagatgatcaattggaagttagtttagctgacgccttgatgatcaatcgagcatacgaattagatgatgaaatcagatttgaagttactcctaaaaactttggccgaattgcagctcaaactgctaaacaagttattatgcaacgggttcgcgaagctgaacgtggtgtaatttacgaaaagtatggtcaatacgaagatgaaattgttacaggcgaagtatcacaccgtgataatcgttacgtatatgttgacttgggtggggtcgaagctgtgatggctaagtcagaccaaatcccaggtgaacaatatgaacctcatgatcatattaaagtttatattacgaaggtggaaaataacggtaagggacctcaaatttttgcttcaagaacggattcgggacttttgaaacggctctttgaacaagaagttcctgaagtttatgatggaacggtcgagattatgtcgattgctcgtgaagctggtgatcgtgctaaaattgcggtacgttctaatgatcctgatattgatgcagttgggacatgtgtgggtgctaagggccaacgtgttcaaacgattgtcaatgaacttcatggtgaaaacatggatatcattgaatggaaagaggacccagcagaatatatagctaatgctttgaaaccttctgaagttattgacgtattatttaatgaagaagatgaaaattactgcatggtaatcgttccagattaccaactttcattagcaattggtcgtcgtggacaaaatgcgcgtttagctgctaaacttgttaacttcaagattgacatcaaatcggaaacagatgcatcagaatatgctgaagaagaagattctgaagaaagtacagaagaaaccgctgaataaatcattggaggtgtgttcttgatgaaaaccagaaaaataccaatgcgtaaagacattgtgacaaatcaaatgtttcctaaaaaggaactcgtgcgagttgtcaaaaataaggaaaacgaagtagctattgatccgacgggtaaagctgcaggtcgaggcgcttatattggattagatgtcgaaattgctaaaaaggcaaaaaagaagcgaacttttgatcaagcgtttaaaattaaagttgacgaccagttctacgatgacttaattgcttatgttgatcatcagcaagcacgaaaagagttatttggtaagtaaatgattaaagaaaatattagtaaatatctcggattgatgcgccgttcaggtaacttggttactggtcaagaactagtactcagttcaattcgtagtcagaaagccaaattcgttctggtaacagaagatattggcgagtcctcaaagaaaaaaattattgataagtgtcatttttacgaagttccattcactattttgggaactaaagaagatctttccaaagcaattgggcaggaaagatcggtagtggcgactgaaaataatggttttgcaaaggggttactaaagaaaataaatgaataggagcgtgaaacgatgggcaaaaaaagaatttatgaattagccaaagaaatcaacgtttcgagtaaagatattattgaaaaggcgcaggccgatggtcttgatgtaaaaaaccatatgtcgacgctagacgatgcttctgaaaagcatttacgcaatgctttcaaaaaaaatactactacaaacaaaccggaagaaaaacggacacctaaattccgttcaagcaaaactggtaaaactgtggttaagaaaagcgaccatccagcagctgatggaacgaagggtattcaaagattgaaatcatcaaataatgaaagtactacaagaaacaataacaataacaaaaatggcaaccaaaaccgtaataatacaaatggtcgtccaaacaataaccaaaatcgtccaaacaacaatcgtaatcaaaataacaaccgtaatggtaatcgtcctaaccaacctaagcgcgatgaaaaacaagatcgaattcgtgcttcagtagcagaggctgcccgtatggctgctcaagctaaccgcgaaattgctaacgagaagccccaagctaatcgtcaacgcacgaatagcgctaagccaggtgaacaacgtcgggaaggtcgtaataaccaaaatcgtccaaacaacaataatcgtaacggtaacaatgtaaatcgtacgaataataataatcgccctaacaataacaatcgtaacaatgaaaatcgtccaagtcgtccaaataatactaatcagacgactaataatcgcccagctaacaatacaactagaccagctgctccagcagctacgacagctaataatagtggcgaaaagaagcaagatcgtttcagtggacgtaacaacaattctaggggtgggaaccgttttggaaacaaccaaaatcgtccctttaataaagaaaaccgtaagaacaaaaagagaaatagaaaagctaaacgcgatgggcggatgaaggaaacaactaacaaagttgttactgttcgtaaggaacgtccattgccagatgtattagaatacagcgaaggcatcaatgtagcagagattgctaagaagattcatcgtgaaccagcagaaattatcaagaaattgttcatgatgggtgtaatggttaaccaaaatcaatcacttgataatgatacagtggaacttctagcagccgattatggaatcgaagctcaacaaaaagttgaagttgatatttcagatattgataagatttttgaagacgaagaaaagaatacaactaaccttgtatcacgccctccagttgttactatcatgggacacgttgaccatggtaagacaaccttacttgataaacttcgtcatagtcatatcactgaaggagaagctggtggtattactcaaggaatcggtgcttaccaacttaagcatgatgataagttgattactttccttgatactcctggtcatgcggcctttactgaaatgcgtgctcgtggtgctgatgttacggatattacaatcttagttgtcgctgctgatgacggtgtaatgccacaaactattgaagctatcaaccatgctaaggctgctaatgttccaattatcgtcgccgttaacaagattgataagcaaggagcaaatcctaaccatgttatggaacaattgactgaatatggtcttattcctgaatcatggggtggagacacgattttcgttgaaatttcagctaaattaggtcaaaatatcgatgaattacttgatatgattttacttcaagcagaagttctagaacttaaagctaacccagatcaaaatgctgctggatcagtaattgaagctcaattggatcctggtaaaggttctattgcaacaatcttagttcaacaaggtacaatgcacgttggtgatccaattgttattggtaacacctttggacggattcgaacaatggttaacgaacatggccgtcgagtgaaagaagctactccatcaaccccagtagaaattactggtttgaacggtgttccagaagccggtgatcgtttcgtagtctttgatgacgaaaaatcagctcgtgcagctggtgaagaacgtgctaaacgtgctcaaatggaagaacgtaaacgtagcaaccatgttactttggataatctctttgattcccttaaagaaggcgaaatgaagaaggttgacatcattatcaaggctgatgttcaaggctctgtagaagctttagctgatagtttacaaaagattgaagttgaaggtgttcgagttaatatcattcataaggccgttggagctattaacgaaagtgacgttacccttgcagctgcaagtaatgcgattatcattggtttcaatgttcgcccaacagctcaagctaaacaaatggctgactctgaagatgttgatattcgtctccatcgtgttatctataacgcaatcgatgaagttgaatcagcaatgaagggaatgcttgaaccagtttacgaagaagaaattattggtcaagttgacattcgcgaaacttacaaggtttctcgtgtgggtacaattgctggtggttttgtaactgaaggatttattacacgtgattccggagttcgtttgattcgtgatggtgtagttatctatgaaggtaaactaggtagtcttaaacgtttcaaggatgatgttaaagaagttaaacgaggatttgaacttggtttaacggttgaaaattacaatgatatcaaaattggtgatgttatcgaagcataccgcatgaaagaagtaccagttgagtagataggaggaatctattatggctcgacaataccgttcggatcgcttgtctcaagaaattgaaaaagaagtgagtgatatccttcgtcgtcgtgtgcgtgatcctcgcgttgagggagttacaatcactggcgttgatgtgacaggtgatttacaacaagcaaaaatttattacagtattttatctgataaagcatcagatgatcaaaaaaccaaggcgggtcttgaaaaggcatctggtttaattcgtaaagagttaggtagccgcctatcaatttacaagacaccggaacttagtttcatcagagatgaatctgttcaatatggtgataaaattgatcaattactcaataaattaaatcgtgattaatccaaaagagtatgcttaatggcatgctcttttttgtttggacctaaataaataggacgaaatctttttaatacgatataagtaatgtaaaatggctatgaagagtgcattttaagtacagaatgagaggttaccaaaatggatggaataattccaattaataaagaacgaggaatgacaagtcacgatgttgttgccaaggttcgaggtattttaagaactaaaaaagttggacatagtggaacccttgatcctagtgttgacggagttttaccaatttgtgttggcagagctacgaaagttgtggactatttaatgggatttggaaaagtttatcaaggttcaattacgttaggtttctcgactactacggaagatctagatggtgaagtagttgaaaccaaaaaacttgatgaaccattaacggacgaacaaattaatcaaactttgactgcaatgacaggaactgtagttcaaattccacccatgtattccgcagtaaaggttaagggtcgcaagttatatgaatatgcccgcgctggtgagacggtagaacgtcctcagcgtcaaattaaggtttatgattttgttcaaactcgcccatcaatttttgatgcagaaaaggggcaacaaactatttatttcaaggttagttgtggcaaggggacgtatgtgagaactttagcagttgattttggtcgtcattttggattaccagcggtgatgtctgatttaactcgcttggctagtgggggattcaaaattgaggaatgcctgacgttatccgacttagaacaagcacgagatgaagatcgtttatcgacgattattcagcctttagatcaagccttggataactttaatacaattacaatttcagatgttgaatgggaaattgttaaaaatggaggatttttgaatcgtccgcaaactgatgaaatcatagctttaaaatataatgggaatattcaggcgttatatcagtatgatacaaatcgtcaaaactatattcctaaaaaaatgttgttggtgagatagaaaatgcaaatagtaagaatacatcatccatattcaaaaaaaataattccagcagaacctgtagcactagctttaggtttctttgacggtgttcatcgtggacaccaagcagttattaagcaagcttgccaaaaggcccgagaacagcatttaaaggtggcagcaatgacgtttaaccatcatgcgtcggtagtatttgaacaggatcgtaactttagcccgttaagctacctaacttctgtagaacgcaaagcggaattaatgcgcgaattaggcgttgatatactttatgttgttgatttcacttctgcatttggtagtttaaatcccgaagattttgttcaacaatatatggtagacttaaatgccaaagtggtagttgcaggttttgattatacgtttggacctgctgagctagcgaacatggatactttaccagcgctagctcagggacgatttgaggttattaaagtacctaaaatcattttaaagaatgataagattggatctggtaagattcgtgagatggtatcgttaggaaatattgatcatgctaatgcctatctaggttatgcttttcaaacgagtggcgtggtggttcatggagaagcacgtggaagagaactcggttttccaactgctaatatagtttctaatgaaaatcaaattacacctgggatcggaatctatgtcgttgaaatcaaagtaggcgaccgatggtataagggaatggcatccgttggcaaaaatgtagtctttggggaaggtcgtcctgttactactgaaattaatattttagattttaaagaagctatctacggagagactgttaaagttaaatggtaccatcgcttacgaggcgaaattaaatttgatttggttaatgctttaatcgcacaactgcatcaggatgaagctgatacaagggaattttttaacaagttataaagatgtctgaccaaatttgactatggttgacatttctacaaacctctggtatcttattaagtgttcttagcactccaactttctaagtgctaaaagaggtgattttcatgttaacagatcgtgagttgttaattttagaggagattgtccgagagtatactgagaatggtcagccaatcggatcaaaaacgttgatgaataatcttccagtaaaagtgagttcggcaacgattagaaatgatatggctaagctagaagagatgggtctgattgaaaagatgcattcatcttctggaagaattccatctttgatgggatatcggtattacgtagatcatttgttaagccccaagaagttaaatcaaagtgaggctcaacagattcaaaaggggctggggatgcattttagagaagtagatgacattgttcgaacttcggctgaaatgttatcaaatttaacgcattatacagcgttaacgttaaaacctgaccaaaaagatgcgactttagatggttttcgaatggttccactcggtggaaatcaagtaatgttgattttggtttctagtaatggcgacgttactagtcagcaattttcgatcccccgaggaatgaatagtgagactgtcgaacgcgtcttgagaattatgaatgatcgcttgattgacgaaacgcttgatcaagtttattatcacctgaaaacagatattcctaaaattgttgagcattatctgcatagtaacgacggaattattgatattttcgaaaatgtagttgcgcagtcttcacaggaccgttacttcattggagggaagttgaatatccttaatttctccaagaatgtagatgttagttcaattagagggcttttgactctatttaatgagaatgatcaacttgatggattacttggaaataatcagagtgacttagatgtaaagattggcgatgaattaagcaatgctttactaaaggattttagcttaatcactgctacttatgatgttggtagtcgaggcaagggattaattgccattctcggtccaactagtatgcagtattcgaaaacattaggcttacttgatacatttagagatcagttgtctaatcgaatgctcgaatattataagcaccttgatgatagttaggaggattgaattggcaaaagagaaaaaagaagaagttaaagaagaagaagtttctgaagctacttcaacagaagggtcagcagatgttgaatcaactaataatgatgattcaactacagaaactcaagcaacaacggctttagatgacattaaaaaggtggaagccgaacgcgatgaaatttcagacaagtatattcgtgctcaagctgaaattgttaatatgcgtcgccgaaacgaaaaagaacaggcatcattaattaagtacgatggtcaaaaacttgcaaaagcaattttgccagcacttgataatcttgaacgcgctctagcagttgagtctgcttcggaacaactcctaaaaggggtcaagatggttcaaaccgatttgttaaaggctttgaaggaaaatcacgttgctgaaattgaagctgaaggacaagcttttgaccctaatatgcatcaagccgttcagacggtgccagctgatgatgatcatccagccgatacagttgttcaagtattacaaaaaggatatattttaaaagatcgagtattacgtccagcaatggtaatcgtagctcaataaaaaaagaggaagagggattttaaacaatggcaagtaataaaattattggtattgatttaggtactacaaactctgcagttgctgtcatggacggtgacaaaccaaaaattatcacaaaccctgaaggagcacgtacaactccatcagttgttgcttttaagaatggtgaaactcaagttggggaagttgctaagcgtcaagcaatcactaaccctgatacaattgcttcaatcaaacgtcacatcggtgaagctggctataaagtaaccgttgatggcaagtcttatacaccacaagaagtttcagcaatgattttaagttatatcaagaaatttgctgaagattaccttggtgaagaagtagataaagctgttatcacagtacctgcttactttgatgattcacaacgtcaagctacaaaggacgctggtaagattgctggcttggatgttaaacgtattatcaacgaacctactgcatcttcattagcttacggactagatcaaaacggtaaggatgaaaagattctcgtttatgatttaggtggtggtacttttgatgtttccgttcttgaattaggggatggcgtattccaagttctttcaacaaacggtgatacacaccttggtggtgacgactttgatcaaaagattatcgactggttagttgatgaattcaagaaagacaatggcgtagacttatcacaagataagatggctcttcaacgtttgaaggacgccgctgaaaaagctaagaaggacctttcaggtgttagcgaagctcaaatcagtctaccatttatttcagctggcgaagccggaccattacatcttgaaaagactttgacacgtgcgcaatttgatcaattaactgctgacttagtggaacgtactaaggctccagttgaaaatgcgcttaaagatgctggactttcagcttctgaaattgacgaagttatcttaaatggtggttcaacacgtattcctgccgttcaagaagccgttaagaactggacaggtaaggaacctaaccactcaatcaaccctgatgaagccgtagctttaggtgctgctgttcaaggtggtgtgcttactggtgatgttaaggacgttgttttacttgacgttactccactctcacttggtattgaaacaatgggtggtgtattcactaagttaatcgatcgtaatacaacaatcccaacaagtaagtcacaagtattctcaacagctgctgataaccaaccagctgtagacatccatgtacttcaaggtgaacgtccaatggctgctgataacaagacacttggtcgtttccaacttactgatattccagctgctcctcgtggaattccacaaatcgaagttaagtttgatattgataagaatggtatcgtaaacgtttctgcaactgataagggtactggtaaggaacaaaagattacaatcaagagttcatcgggtctaagtgatgaagaaattgatcgcatgatgaaggaagctaaagaaaacgaagaagccgacaagaaacgtaaagaagaagttgatcttcgtaacgaagttgatcaattaatctttacaacggataagactttgaaagatcttgaaggtaaagtttctgaagatgaaatcaggaaggctaaagatgctaaagaagctcttgaaaaggctcaaaaggataacaatcttgacgaaatgaaagctaagaaagatgacttgagcaagattgttcaagatctatctgtaaagctttaccaacaagctcaagaagcccaaggccaagctgctgatggagctcaagccaacgctggtgacgctaagactgatgatgacaatacagtcaatggtgattttgaagaagttgatccggacaaggataacaaataaataaccagtaatcgtaaaaaggtcaaagtcagtgactttgacctttttgcatgattatctgttaagataagctaatagaaatcatggaggatgaatatggctgcaaataaagattattatgacattctaggcgttagtaaggatgcgtctgatgatgaaattaagaaggcctaccgtaagctttctaaaaagtatcatccagatatcaataaagcacctgatgccgaacagaagtttaaagacgtcaatgaggcgtatgaagtcttaggtgactctcaaaaacgtgctcaatatgatcaatttggttcagctgatccgaatgcaggctttggtggcggtggatttggcggccaaggtggctttagtgacttcggtggtggattcgaagatatctttggttcattctttggtggtggacaacgccaatcaccaaaccaaccacgccagggagaagatttgcaataccaaatgagccttaaatttgaggaagctatctttggtaagaagacgaccatcaagtactctcgtgaagccctatgtaaaacttgtggtggatctggtgctaaagaaggtacttctcctgtaacttgtcataagtgtaacggtacgggtacaattcaagtaacccaaaatacaccacttggacgaatggttcgccaacaaacttgtgatgtatgtaatggtacaggtaaggaaattaaagaaaaatgtcctacttgtggtggtacaggtcatacttctcaacaacacgaagttaaggtatcggttcctgctggggttgaagatggacaacaaatgcgtctccaaggtcaaggagaagctggatttaatggaggcccttatggggacttatacattattttccaagttcaaccaagcgatatgtatgaacgagatggttcagaaatttattacaaccaaacgatttcatttgttcaagcagctttgggtgacgaaattgaagtaccaaccgtacatggtaaggttaaattaaaggttccagctggtactcaaacgggaactaacttccgtttgaaaggcaagggagccccacgtttacgtggtaatggaactggggaccaacatgttaaagttaaggtcactgtacctaagaagcttaacagcggacaaaaggaagccttgaaacaatttgctaaagctagtggtgaagaaccttctggtcatggtaagagtggtttctttgataagtttatgaattagaaaaaaggcgcgcaagatttttattcttgcacgccttttttgagtctaaaaaacgctatacaaggtgagtatgtagattactcatccatctatagcgttttttttaatagttattatcattctttttttctggttgagcactaatcaaaccaaaaaatttaagacagtagatggcactaataccaactaaaacatatacaatcctagaaatgattgctgcttgacctccaaaaagtgtagctactaaatcaaattggaaaataccaactaataaccagtttaagccaccgacaatcaatagaacaagtgctataacatctagtgttttcatggttgaatcctcctttagtctcttattttcggaacaacttaattctagcaaagttaattgaatatacctaaaaatacacttacaagtaaattaataattttacaatcaaatgatgcaataacagaaggttagttaaggatggctgttcctaaggttaggtaagtagcaaataaaatccaaaggaaatacggaatcattaagtaggctgccaatttactactcttataaaattccttgatacaaaagaatactagtgcgtctaatacaagaatgattaatagtccggtccaacgactacttgcgttgaaaaatacaatactccaaataaaattcaagaaaagttgggcaataaataatgttaggtttgttttgcggtagttacttctaactgtgaaaattaggtagccaacgataccaatcattaagtataaaattggccacacgataccaaacaaacgatctggtggtgagaatggtggcaaagtaaagctattatagatggctttgatgtcaccagctaataatccagataatgagccgattagttctactccaactaccgcaataattaattgaatccatttacttttggtttgcataaaaatccctcccttatattttgtgaaacctatctcattaaggttagcttaccaaaagtgggggagagaatataatattttgcttaggtagtggatcaaagatttatacagctgtaaattgtcattaattataaatagcgtatagttaaaattatttgagaacaaattaggaaaactgtaattttgcaagtaaaatgcgatattttgtatattgttctaattaattttatgcccaataatagtattaaggaagcgctttctgatatgctttgcaaaaatatatttattgtaaagcattcttaaaagcagctgtagattatatatcaattattgaggagctgatccaaatgaatgagattactaacaaaaaaatggataaaaaagtcatgtcactagttttaattgccggaactgcttcatatttagatgcgagtttattagttagtttaggcgtagcactacctatatggactaaaattttagatttaactcctatcctgagcggattaatctcaacgttgttaacattaatggtagctttaggggcaattgtaggtgggtggttagcagataaatttggtagagtaaaagtttttaatctagatattttatttgtagcagttggggctattattatagctttcgcacctaatttgccaatcttattaattggaacggtggttgcaggtttagcctcgggagcagatttaccaacatcccttgcggtaatttcggaaagaacttctagtcaaatgtacggacgctcaattactataactcaaattttttggacgattggaattttgctctcacaatttattggttttttaacatcaggaatgacagttggatcagtaaggtggatttttagtgtaattgcttttgtagcattctgcaattggtgcatcagagcattttctaataaattcaagaatattgaatctagcctagaggaggaagtcaataaagaaaatcatatgattcaacataaaaaagttagcttaagagacattcttaaaaataagcaatatttaagtgttttgattgctttaacggcgttttatctattctggaacttaccagctaacacgtggggttcgtttgttaattactttttggttactgtttcacatcgaacacaagcatacgcaacgattgtagctttaattgctaatttatttaatttggcatcaaattcaatttatgtaagagtatcagatacaaaatatcgttatccagttatgtatggagcaattgttattggatgtatagcatttttctgtgctggcatttggagtagtgtatggtgggtgtttacaatcgcatatattttatattcttcaactaacactttatgcggtgaaccaatttacaagatatggacacaaactttttatcctgtcgatgtaagggcatctataactggattttcgtatggatttgtacgattttttacggtaatattttcattatttactccaactttgatggcttggtctgtacaaaaatttttatggataatttttgtatgcgctttattatcaggtggatgtgcaattatcatcgtacaaatggtatataaacaaaaaaataagtaattttaagaggtgtataaacatgaaaaagtattggatttggtacccaggagattttgagatccatcaaggaatgttacaaaactttacccgtgaagaacgtgggatggcttggcctgcgtattggtatgtagatgattgttataaaaatatcaaatttgagcgggtttataatctaacagaaagtactatatttaaggtgatcactcatcagaagggctatattactgtagatggtaataaatttcgggttaacgaagatattaaagtggatgttggtgaacatgaaattgtcgtatacgtatttagtagtaatcaattgccaacagtatatattgacggaagcgttatttattcggatggaaactggttagccaataattatgtgaataaacgtcaagtaggatataataaattatttaaaaaaattactgacgatcctaataaaattccatatgaacgagttacgttaaatccacaaacttttacagtgaaaaataatggtttgttagtggattttggtaaagagattaatgccgaacttagtttcagtaaactagcgcataaaataacggtttgttatggagagtctgaaactgaagctctagatacggtaaaatgttattacaaacaatcaaatattagtaaccaaactaagcttccaaaaagagcatttagatatttatttattccagaatttactgatagaaatattagtatcacagcaactaatgtatttttaccaatgaaaaatgtatcacagtttatatcagataataaattaatgaatgatatttggaatatctcgattagaacttttaagttatgcagtgatttattttatattgatggcattaaacgagatcgctggatttggggcggagatgcctatcaagataattttattaatcaatattcattttttgatgaagatattgataaaagaaccataatagctctacgcgggcatgatcaagttcagcaacatataaatactattgtagactattctttactatggattattagcatctataatcattatgagatgactgctgataaagaatttatccaaacaattatgccgcgtatggaaattatgatggacttcttgctaaaacaaactaatgaacttggatttatttatgggcgtgatggagattggatttttattgattggtctgaaatggataaagaagggactatagctgcagagcaaatgtttctattacagtcattaaaagcaatcattgcttgtaaaaatattttgggcgaagatgcagagagttatgttcaacaatttgaaaaattaaagcaaaatattctaaggtatttttggaatgaaaaaaaaggcgcttttattgatagttacgaatctggaaaaaataatattacaagacatgctaacatacttgcaatattatttgattttattggtaataaaaaaaagcaacaaattttatctaatgtacttttgaacaatgatgttacacaaattacaacaccgtattttaaattttttgagcaagacgcactatgtaagttaggtcaattacctcaagtttatcgtactattgaagaatattggggatctatgattagaaagggagcaacgactatttgggaagagtataatccaaatctaagtgatgaccaacagtatgcgatgtatggtgatccatttggaaaaagcctctgtcatgcttggggagcaagtcctatctatctattaggaagatatttctttgggttacgcccaacaaaaccaggatataaaacgtttgaaattaatccgcatttggaaaaatttaaagaattagaatgtactttaccaattaaggatggtgtagttaagttcaatttgaaagatgccaaactaactatttggacaaataaaacgggaggtactgttattaataacggtataaaaattagtctgaataaaaatgaagagttaaccatttaggcttctttttaagaattattaatatggttattgctaattagttggtgacgataatcgataggtgtgatatttatatattttttgaacaaacgatgtagtgaagaagggtttttataacctattttcattgaaatatcctctaatgataatttggtacggtatagtaaatcttgtgctgcatataaacgacgctgttcaatgatttctttgtatgtttgtcccgtagaggatttaattttattactcagatagttcatgttatacccaaaatgttcactagttaatttgaggttcgtactagaatagttgcgttcgatatattttagtatttctaatatgtttgaatcattactattaaagtcatttttgtagtattgaatagtatcttctaattgaattagtagggtggagaataaaagatcaattgtaattctatttttgtttacattatttgtcgccatttcgagagaaataatatttttaattaaactttgggcgattggtgaggaatttaagtcgcatataataaaattattgctattagtttttaaattagtctggcttaaaaataatgaaattttattttcgtatccttttagatagtctaacaaacgattaatagttacggaatctttaattaaaatgtttataaggatatcttcctgaccagtgtatccaattttttggacagtatttttatccattattaatagctgtccctgtgtaaaatcaaaatcttcattattaagtgattgggtgcaacgaccagaatacatgtaatttagttctataaaactgtgcgtatgtgctgggacatatgaaaagcgattagccttagttacattaatatcattttctttaaaaaaattccattttggtatcgtaggaataggactctcattaaaatctaaattcatataattataatttatttttgatgttttctgtatcttctcgacataattaaatgtatatagatatcgctcaagaattaaatcgttcatcataatactccttatttactgataaacctgtagttatgcattttttttagtggaactatgatattgtagcaccttttacaagcgcttacaattataaatataaataggaggaataattatgacaaataataaggcattaaaaaaatatcgtcctttggccactgcatctggtataggatcgattttaggttcgggtatcattgtaggcttatccgctacaattacggtatggcaacaaggtttaggtttaactaacatgcaagttggggtgatttctggagcattaacttttgcaattgccttgggttcattaattacaggtatgatctccaaaactttcggacttactaaggcatttaattggttgaacctattctatgctattggagcattgatttgtgtatttgctaatagttatttactgttacttgtaggtgttattattgctggatttgcttcaggggctgatctacctattagtttaacggttatatctagggatgtacctgatgaaaaaacgactgcaagtttggtatcgtttacgcaaattttttggcaaattggagtattcttctcgtatggatgtgcgtttgtagtttcaaagatgtcgggagctactggagctagaatcatttttacgattttatcgatttgtgctttattaacatttttatggagaagcttttcaaaaacatttagaaacttacatattgaagcggaacaacgaaatgatgataggaaacaaaatattaaaaataatcaaaaacaatccatgttttcgttcttaggtagtaacaaaaaatatttagcattcttttttagtatattgattttctacagctgttggaacttattggctaatacttttggtcaatttcaaacatttactttagtacaagcacatgcgagtcaaagttttgctacaggcgcagggttggtgctaaatattattgcattaatcgcgtctatggcattcgcatcggttgcaggtggtaaatatcgtaataaattcttttttgtaggtattgtggttcaatttgtagcaatgctaggtttagcacttagtagccatgcgttatggccaatcgttttagcaattggattttataatattggaaataatatagcaggggaagatatgtataaggtatggacccaggaatcgttcccaatggaaaatagagcatcaattcaaggctttatcaatggattctctcgattcctttgtggattatttgcctttattacaccagctcttgtagtaccagctcatattaggacttcgatgtttggttttgcaggtatcgttttactaagctttatagctgggttaataatgatcaatttacagaaaaaatataaagtaaataaagctttggaggacaaagaatgagtttcacatttcagattaatagtgatgttgaatttaatcataataaaaaattattagataaggctgaggataacgtaactgagttatatcatgaagttaagacacctcaacaaatcgttacagttgaaaaaaataagcagaaattagatggtatcggtgtaaaaaaaatcgctgatatcaatgaattagcaaaaatgtcactaggaagaaatgaaagagttatcttagattttggagatcattatgtaggaagattttcaattaaagctagatccatcggttcaccaatggatgcaccgttaactgtaaaattaaaatttgctgagttgcctgctgaactagaacagaagagtgaggattatgatggctggctaagtaaatcttggatgcaagaagaaattttacatcttgatcagttaccagcgataattaaattgcctaggagatatagctttaggtatgttgaacttagcgtaattgatacctctccaaaatggaaaacaatattttctgaaccaacattattaactgaaagttcagcaaataatcatttaaaggaatttaaagtgaaggatgcagaactaaaagaaatctataaagtgggattaaaaactcttgaagattgtatgcaagatgtctttgaagatggtcctaaaagagaccgtagactttggattggagatttacgcttacaagctttagcgaactatgcttctttcaaaaatacaactttggtaaaacgttgtttatatctttttgctgctatgacagcaaaggatggacgaattccagccaatgtttttgcaggccattcttatgctccagatgatacatttctattggattacagtctattctttactagtattctagatgattatgtaagagaaactgaagattataaccttctagatgaactatttccaattgcaaagaaacaaatggactatgtattagatagatttgtaaataaagacggttcaattaatcttaacgaagattatccagtatttattgattggtcaaatgattttagtaaggaaacatcagggatcgctgtaatagtatacactttaaaacaatttaatcatttattaaaactacagaaggttgaaagaagcgatcaggtaaaatatattaataacatagaaaaaattattgattatataaagaatcatttgtttgataaagagcgggggttgttcttatctggaacaaaccatgaagttaacattgcaagtcaagtttggatggtattggcgggagtctttgataaaaaaacaaataaaaagattatgcaaaaaatggttacagagcttttcccaattaaaggtattgctacaccatatatgtaccatcatattactgaagcattatttcaagtcggattggaagaggaagcagttaagcttttaaaatcatattggggtggtatgattcgactgggtgccgatacctactgggaagcttttgagcctgaaaatcctagttattcaccttatggtagttctatggtaaatagttattgccatgcatggagttgcacgccagtatatttaattaaaaaatatctttaatttaaaaatcttgttttttatgaaagttaatttaattcataaaaacaagatttttttctagcaaaactaaggatgacattttctcaactaaaagctaatattaaatgtgtcggtattaaatttcatctgataccaacacacacggtggttcgaaatatcctcccgcctcaaactaaaactaggagagttacatatgcataagattaatcgaaatatttccgctacggccatcatagcggctctttacgtggccattacccttgcactagcacctatcagttttggcgtagtccaactacgactttcagaaatgttcaaccatttggcagcgtttaataagcgttatatttttgcagttacgttaggagtcttgattgtgaatgtatttagtccattagggcccattgatatgctttttggtacggctggaaccctaattggaacaacgctaacgtacttttgcacacgcaaagttacgtcattggttggtaaatttaccattgcgacaatttgccagttaccggggatgttactggtggacttagaaatgcacttatatagcaatcttcccatgtttccgacttattggatattggctgcgggtgaacttgcctcaatggtaataggcgcgtttttaatctacttaatttctactaaagttgacttatataaataaaaaagaggttgaataaatgacttttgaaaaaatactacctattttaaaaaataatggtaaagcaattcgtgaacagtgggatggcgatgaagaatttatcttagtagtcaaagatcaaaaatttaataatattcccgtaactccttatatgttaattaaaacgactagcgaaggctattctagctttgcacctaccgtttgtgacgtgttggcagacgattggaaggtcgtggattaattggttaattatcctgagttaaagaataagtatgttttacttacaggagctaattctggcattgggcttgctcaagctcgcgaatttttgggtcaaggtgcaaaagtaatcggactcgattgcaatgtagatcaaatgcaacaactaaaagcaatatatacgaccaattttggttattaccaagtggatttgactgatgaaaaacagttagatacggtaattggtaagataagtaaagtagacattttattaaatacggctggggtacttgacgattatcagccaattgaaactacttcgatcaatttatggcagaaaattctggctacaaatgttacaacaatgtttaatgtaactaaaaagattttaccgcggttagctgaaggttgcgttattgttaatatggcttcaattgctggaatggttgctggcggtggtggtatagcttacacaacttcaaaacatgccgttattggttttactaaacaattagcactagatttggctgagcgaggaattcgagtgaatggcattgctccaggatgtattgatacaccgatgaatgcaaaagattttgcaaatggtggggagatggctaagtctgtcgctaaagaagtgcctataaaacgctgggctggagctgaagaagttgccagagttgctacatttttagctagtaatggggcaagttacttacagggaacaattattcctgttgatggtggctggatcacaaaataatttaaagcttttcaactttagttggaaagtttttttgttaaaaagtatatttttagtttacattttagcttttaaaacgttactaactatgagtacatctttttaatcataggaggtgccttaatggccagaccaacaaaagcaggcttagattattttccatttgacgttgattttaatgcaaatgaaaaaacggaagctattatgggagaatttggagctaaaggagttttaaccacgatttttatcttttcagcgatttataaaaggggatattttttggagtggacaccacttgttaaaaatagccttgcaaatcgaattgatggagttaatagtaaattggtagagcaggtagttaaccgcttggttgcttacgggacctttgatgaggaactgtccaactcggctaaggttttgacaagctcacgtattcagaccatgtatttagaggcgactaaaagaagaaaagcgccaagacccactctgtattggttagtcgatgagattgagaccgagattaatgttgacattaatccacaaagtaaaggaaataaaaataaattaaactaaagtaataaagaccttaatttaattaaaggcgactgtgtaaatgatccaattccaatggtaaaacttacttaaattactaatatgagatagaaaaatattgaacagctttaacaccgttagtaacaaaaagaaacttaaatgacaaacatccagcttttattgttataaaatgaaagttataaggcacaagaccttttacttgtttatattatttagctttgataacattagttttacttagttagggaaggaggcgtgaacagatgggacttatttggacattgattgtaggtgctattattggtgttattgccggggctcttacaagtaaagacatgcctgctggttggattggcaatattgttgctggtttggttggttcttggctaggacaaagcttattgggtacttggggaccttcattagctggtatggctttaataccatcaattattggtgctattattctagtagctatagtttcttggattctaaaagctacacataagtaattagctattttatataatattttgaggatgattctaaatagaatcgtcctttttatttggataaaaattatgaatgattaattgttagagcaaattaaaaagtaccttaaaatttatatttcttcctggacataaattttaaggtactagcttattaaaattttaattatttacccttgatcattgtgtaatttggggtcagcaggtttaatatgtgggatgctactcatagcttcaggattttcttgatatgtgaatttttctccatctcttgcgatttgtccctcaaaagcttttgaaccatcaccatctgaaaaattcatcagaacatgactaaattcactatgttcaatgtctttcgtatcaccaggcacgatgactccatacttctcttcaagttcttcttgtgccttcataaattgaagttggtgttgagtttcgcgggctaacaggaacttcaacatatcacgaataccttcatcttcagtcatagaatagagtcggctgacttgtaacctagcctctgattctctgacgacattaaatcgcatatcagcaactaaattaccacttgatgttacatagtctgcattccatgctgagccattgggattatttaggctagcatttaaaccatgaactagagcgtgttctgggtccatacctgccatagttactgctaatgatggatctctttttaaatcttcagcactaaatggtgcttcttcaagtaaatatccaatcattgttgaaatcatttcaacatgagctatctcttctgtaccagtatctaataataaatctttatatttttcatcaccagttgatgcccaaccttgcgaaagatatgacatcatccctgtagtttccccccattgtccaccaagcgcctcctgtaagcgtctggccatgattgggtctggatgatttggtttggcattgtattgcagttttcttgtatgtttaaacataaagacacctctttcttaagtgaaaaacgaagttacgttatataaaacaacatagtacaggaagaaatatatcatgattgtttatttaaacataataatatgttttgaaacatatattcataatgttagcgggattaaacgattattattgagggacagtattaagctaagatttaaaatgtttagaaaatacggtgaaggatttaattagaaatactatttttgggtataagtaagactttataaattttacaatatattcagatatcggttttttaaattagatttttatagagatagatttttaattccaccaacggaatcgaaccgttgcaaatcgccagagtggaaaagtattactttatattggactactcgtaacagtcattagcattcacttcaactatttttactactcatatttaaaggatttagttgatttagtcagagattaaaaaacaacgtatcaattacgttgttttaaatgattattattgtcttagattacacgaggacattcgtaaaaatcggagtttggtgaatcaaagtcaggactatatgtaccatcggattcttttaaaagtttatagtttgatgatacttttaaattaccgggcgttatttctgaaactaatattaatccgtttgaatattcatgcctagcgtataaacgatttttagatctatcgataatatctactcgaggcaactcgttcgagtatttatcttcatttttgatgcacctcctcaaatagatattatacaagaaaagataaaaatgtttagtaaaaaaggttattaccaagaaatttatttaattggaactaaagtagtaataaaaataccgactaattttttatttctgtaacatagctcaatatatccaagtttttcaagcgaaactaaagcttcaacaaatgtttgattatctaaattagagcgttggcgaattttagaaggatctacaatagtaggtcgtctcgtattagaattctcgattatagtatgcagtaaaatattatagtaattgattgtgaacaccttctttaactagagtatacatgaaataagtaaaaatgtaatagatgacgtattgtacttaggtcaacaatgaagaggcttacaaaaatgaagaggactgtaaagggaatacgcaacgagagaacaatcctgattggttatttaacaaaaaacaaactaagatacacaaatacttacgtaatgattgttttaggagaaactaatgataattaaatattaataaatattacgaagatagtaaattatatgtcgagtcttggttacaaataaattcttttagaagaacatattgtttttctagaagaaaaataaaaatatcctcgaattaacttcgagagtaccgcgtaatttaaagttgtcacttcgatcatttattttcaggtttcggagtgggtggcaatcgatcgcactttcgaatatatacgaactctggaaacaaaacctccacgaggcccaacttcgtggcaagttctagcaggcttattatcagttcttggtttgatattttctgagaacaggatagtcaatttaaaattgtgaaaatgtataatgaaggcaacagatagtagagtaagtttataaaagttttaaaacgaaaaaataatttaaaaccgtcctgaacacgacgctagaccgctcttttttatgctcaaaacatcaagtaaaagaacaaccttagaatgtaaacgaaagcagtatagaaataaggtatgtttgtatggtagctgattcaaaagcacttaaactacaggtgtaggaaaaataatcgattacaaaataaaagcctatctagtcaaattaatgattagataggcttttttgttttatatttattttctgcgaaaacatctaaaaaatgagttatgcaggaaattcgcagaaaaattaacatttatggtattttttcaaactcaacaatccctatttaccgccctttccctcagtatcagtcttcaaaacggtcatgaaggcttcttgaggaacttcaactttaccaacggatttcattcgtttcttaccacgcttttgtttatccagcaatttagcacgacggtcaggatcaccggtgtgaatcttggaagtaacatctttacgataagctcgaatgttggtacgagcaatgattttatttccaattgcagcttggactggaatttcaaagtttcgacgagggatgatttctttcagactagcggtaatttcgttaccacgttgttgcgcgaagtcacgatgagagatgaaactcaaagcatccacccgttcgccattcaataagatatcaatcttaaccaggtcgctaactttatattcaccgagttcataatcgagcgaagcataaccacgagtgctagacttcaacttatcaaagaaatcaaagataatttctgaaaggggaagggcatacttaacattcactcggttttcatcgatgtaatccattgtatcgaaaattccccggcggaattgcgataattccattacagcaccgacatattcattagggaccataatactagcatttacgtaaggctctttaatatttttaatgctagaagcatcaggcatttcagaaggattttcaacaatcttttcagacccatccgtcatttcgacgcggtaggtaactgatggtgccgtcgtgattaagtcgaggttgaattctcgttctaatcgttcttgaaccacgtccatgtgaagtagacctaagaatccgcaacggaaaccaaaacctaaggcttgcgaagattcaggttcaaattccaaggcggcatcatttagttgtagtttttcaagtgcttcacgtaagtcattatatttagcattatcggtaggatatagaccagaataaaccattggactcatttcacgataaccttctaaaggctgtgccgcaggattcttgaccaatgtaactgtatcaccaacacgagtatctttgatgtccttaatgctggccgttaagtaaccgacatccccagccattaaaaagtcacgcttcaaaggatctggagagttaacgcctacttcgttaacctcgtaaactgaaccgctgttcatcaacttaatcttatcgccaggtttaaccatcccttcaaataaacgaacactcaaaacaactccacgataatcatcgtattttgagtcgaaaattaatgcctgtaagggagcatctaggtcaccatctggagccgggattttttcaacgatttgttctagtaattcgggaattccgatgccttgtttggcactagccatcacggcgtcgctggcgtctaagccaactacattttcgatttcatttttaacccgttcaggatctgcagcaggcaagtcaattttattaataactggtacaatttccaaatcatcatcgatagcaagataaacgttagccaaagtttgtgcttccactccttgagctgcatcgaccactaagacggcgccttcacaggcggccaagctacgagacacttcataggagaagtccacatgtcctggggtatcgattaaatggaaaatatatttttcaccatcatttgctgtatagtgtaattcaacagcatttaatttgatagtaattccacgttcacgttcaagatccatggtatccagtaattgattttgcatatcgcgtttagcaaccgtttctgttagttcaagaattcggtcggctaacgtggattttccatgatctatatgggccacaattgagaagtttcgaatgtgggcttgacgatcttgtaaatctttatattcgttcataataatttccttttcataagtagtcactgtattaaattatatcagaccaaaccttaaaggttaaactaagctaaaaaatattgtaaaaatatatcaattcatttttttgttaaccgaactataaaatatagtaccggttgaggtttctcggattataaatatgctaaaatagtaatatgaatttttcagaaatttaatttttaagttacagcgggggagtaaggtcatgcctgaaaaaaatcagccggcagttgctacgcagtcaagttctgcaccagtaactagtagttctaaaccagcaactaataattcttcaacatcaactaaaccgaataatagtggagccaccaattctaatacaagcacctcggcgagtcaccaagctagttcatcagtgtcaactaacagcaaccatgataaagcgagttcgcaaactaatagcgagtctagtgccaaatctgatagtacacctaaggccagttcacgagtaagtagtaagcaaagtacttattattactacgttaaacctaatagagcaactaattcttatgataattataatagcgatgatagtgatgacacggacgaagaagattcttcatcgagcagcagtaagagcagttcggaagaaaaagttcataaagctaaaaaaagtcggattattactacaattaaatctgattcaaatagtggttcagatattgaatatcgaaatagccatggtggaatgatgactttcttagtagttttgattctactagttggcggctattttatttggaaaaaacgacgtcaaaaacgtccaactagcattggtagacatcaaaaaaagtaaaataaaacctcaaaatttataaattttgaggttttttatttatccaaaaaagacaattaatacccaaccgactaggcctaaaagtaccaaaccgaccaaatttaaaattgaaaaacgtaacatgaaaggctctgagtgacgaatacggaattgtttgtaggctaacaaattagctagtgaagccactagagttcctaatccaccaatattaacgcccaaaaagagaggataaacgtcattagtgaacttggaaaggagaatggtggcaggtacgttactaataatttgactactaaaaattgaactaagatagattgaagcactggattgtagtaattgatgcagggtctgtgtaagaatcggatagcggcttagattacccgctgccataaaaaagaacaggaaggtgattaataagccataatctactttatcgaacacgttatgattaattaacagtcctaaaccaattgcactaatgagcataacctcaagaggcaagatggagaagactcctaacaagacgatcacggtaaccaacccagcaatgatggtttgtttaagattaattgcaggaacgttaatagtcacaccctgaagtggggttttagggactaaaagcaagcaactagctaaaaataaaagactggttaaactgattgctagagccattgtcaacatctggataatgctcaaatgatagtagtttagaataaagagattttgcggattacccataggagtcaacatacttcctaaattagctgccatggtaattaaaatagtagggataaccaattttaggtgtgctttttcgctgataataaataaaagtggtagtaaggtaataatcgcgacatcgttggttaacaacatggcactgaaaaaagatagtaaaaccaacatccctacaatttggcgagtgttggtggctttttgaattaatacactagcggcaaaacttaataaatggagttcttcatagcatttaaccaccaccattaaagcaaatagagcaaaaatggttttccaattaatatcacctaactgtaaagggcttagcagacaactaactaaaaatacgcccaaggcaatccacatgattttgtcatgcacaagtttatttataataatgtccaactccagttcatcgaggtaatgtaattttaatcaaatttaatttaaaaacataaaaagcgcctcagaagagacgctcctaaacgattgattaaagttcttcattgtgttggtaatataatggtgataagtcggttgacttagtaattaagttggcacttaaggcttgaaaagcctgaattgctgtagcgctaatttcgtttccagcttgatttaataattcttttagggcagttgtatcggataattctaaagctcgttgttcaaaatcatgcagttgattccgcatttgaacgttaacttttgaacgagttgtatttaattcttttacgaactccttataatgcgcatcggttaagacactagccagtttgaaaacccaataggcagagtcagcagtgtaaactttagctccatgatgatacatttcaggtgtttccgacatccctgcaaaaaacggcacatatacactttgagccgcaacccccatggctaaccaatggattccaccaacttcaataggttgattaggcttaatttgcaagatgtgagactcttgagtagctggaagactaataggacgaaaacgatgtttttcagcttctgagcctgttccaactgggttatatggcgttccttcataatgagaacttaaaatttgttggacatcttcaatttgaattaatcggctggccttacgaataaatggtaagtcatggctaactggactttgggtaatttctggattaagaatccgctgtccttcccaaacacgaggagtgttgtaatattcatcagaaagatcatttaaaccaaaaatgtttctgaaattaaaactggttgggttgggatttaaatgatgcattgcaacaaattgtttaagatcagccttaaacataaagttttctggatcttcaaaatcaacttcttggatagaaagttggttagaaactaccgcataactatcatctggaatccgttgtgcaacccactggtgtccacctgcagtctccatataccaaacttcattagcgtcggagaaaagaattccattagtctcgttggtaccatatttttcaataatagcgccgaggtatttcacaccttcccgagcagatttgatatagggcaaagtaactgtaaccattgcctcttcaccaattccattttcaactaagggatcataaccgaggactcgattattagtgtaggcactctcggtggcactcattgctaccccatattcattgataccatcttcttcaaataagccgaattcagtggtccattccggagtggcggtatattttcctcgcactgggggaaggggcatcgtaaattggttatcattagatttaaattcagtattagctgcttcatcatgaggatgaacggtaaaatgcttgggccaagctgatttagcatcttcatttctcgcaatgatggttgatccatcagccgtagctgctttaccagctaaaaaacttgtacatgcagaatatttattgtcgataataaggaccttcttccgtaaattacttaatcatagtttatcacacagaaaagtactttgaattatttctgtttcatgagaatatatatatgggtttaaatggataatttaaggaggaaataaagatgccattaattcatattgatttaatcgaaggtcggaatgaagaccaacttcgtggactagtcaaagacgttaccgcagccgtcgttaaaaacacgggggctccagcagaacacgtgcatgttgtgctaaatgaaatgtcaaaaaatcattattcagttgccggaactttaaagagcgacgaaaaataataaaaaaacttcaaaatcaactgaaagatcagtgattttgaagttttttattcggctaaaccgagatattcattgagatactttgcaacaccatcttcggtattatcaaattcagtaatatcattagcaattcccttaatttggtccgtagcatttttcattgccactccacggccaacataatctagcatttcagcatcgttatgttcatctccaaaggcaattgtatcctgtcgatcaatatgatagtaatctgctaggtaggccaccgccttggctttctgaatacctttagaaacgatttccagaacactttggggtccgccccaaacgccgacagtaatatattcaccataatagtgtagtaattgatttttaactttttgagcactattaggttccactaaaatcgtaatcgaagttggattagttcttagcgttttttcggttaaaatttggtcattggaaatttcatgaggaaaaaattcaaatgaagcgggagccgcatgatccgcaaaaaatgaatctttactttcaaccgcaagtaattgaataccgtagtcatctttatgcttcatcaggtcgtagacgaccgctttgttgatggttctggaatattcaccatcccatttttggtgaggaatatgtgttaaagccccattaaaattcgccatcggcgttttaaggctaagttcatcgtaaatatcgcgagccatgcgataaggtcgtcccgtaacaatggaaacgatgtgtccagctgccgtggcatttttgatagttttaatggtttgaggtgagagttgactacttgaatttaaggtggtgccatctaaatcaagagtgattaatttttgatgcatttgatcgctccttttactattttctgtattacttataagttaacatggttaaatttaaaaaactagagtactttaggaagttaaatgaattgttaaggtggctcaacccgttttttttctgtataattaagtccagttttatggcgaatgaataaagaatagaaggaatatttaaaaatgcaactaccagttgattttaagaaaaaatatgaaaaattacttggggatcaagccgaagcttttttagcgagcttcgataatcctgttcaaaagggatttcggattaatccgcttaaatatcacggacatcttcatgaacatgcaatgcaacaatctgtgggttattcagcttggggctattttggtaaagtacgtgggaaaaccatcgatcatcaaagtggactagtttacagccaggaaccaagtgccatgctggtcggtgaattagcccatcctaaaccaggtcaaaaagtgttagatttgtgcgccgcaccaggtggaaagactacttatttagctagtttcatggatcaacaagggttattagtttctaatgaaatcaatcgaggccgagctaaaatcttggctgagaacgttgaacgctttggtattcagaatgcggtgattttaaatgagtcacctgatcgaatggaagatcgttttgccaattatttcgatgtgattgtggtggatgcgccttgttctggggaaggaatgtttagaaaagatcctgcagccatggaatattggaataaagattacccatctgagtgcgctaatcgccaaagagaaattttaaagagcgcgatgaagatgttggcccctaagggaactttagtttattcgacgtgtacctttgctcctgaagaagatgaacaaattatcgcttggttattagataactacgaaaatctagcattggtggatgtccctaaacaagatgacatggatgcagggcgtccggagtgggccgacggcaatccagaactaaccaaggcggtacgtttattccctcatcattttcagggtgaaggacattttatggcaaaactggtcaatcacgggatggagacgcccactgaaaagccccgagctaagaagaaaaagaaacaatcaagcaattcaaagtccctaaacaagacccaggtgaaattgtgggagacttttgctaaagcgtttttgaaagattcaaattatttcgatttagctcatttaatggttcaaaaagatcgcttatattatcaaagtgagcgtttagatttagaaggattaaggtatatcaagcctggattagagctgggagaatttaagaaaaatcgttttgaacccagccagagtcttttaatggccctccccgttgatgaattccaacgagttgttaaaattacagctgaggagtggcgtcaatatgtgcatggcgacgttctgtcgacaactactgctggtaaaggttgggtagccgtagctgtagatgatacagtggttggacctggtaagttagtacaaggtacggttaaaaacttctatcccaaaggcttacggatgaacttttgatttactaaagtgaataaaaattaattaaaaaaatgatctctagaattaggactggttaagctaattttagggctcttttttatttttagctttttaagataatactttgaaaaataaatctcacaataaaaacggggatgaatcataattcaatgctaggatggttaagtaaacggtatagttaggtgctgaatgagtagttgatcatttttttattaaaaagaggatatattacaaaaatgtttaattggttcaaactaaatggttacagcattagtgttgctcttttagttagttttattttaataataaaagtttatttagactgggggatcttgattattattggattaattctcactatcatagctcttcaaaggtttagataagagctagaaaaatcattaacactaatcgggtatatagttataatatactgatgttctatccgataaagtgaaaaaagtaaatttaaagtagtgaggctatacgatacctatggttgaggaattgaaaaagttatttaataatcgagggttggttctatttttattagaggcactcttggtactgattgtgatagtatcaataatactagaagcagtaaagatcaatgacattcatactgttaatgcaatgcgcagtgactttatcgcaaagcaaaaaaaggaagaacgtgcatttagtcgtgccgaaagaaatcttattaaaaaaactaaagaaactacacctaaggtcaatgatgagaaagttttaaacggacggttaagtccttatcttgaaaatactgatgcagaagtatctgtcgcgatctattcaaaaaagaataaccatatttatcaaacaactaatagtaaaagaaccacttatccttctgctagtattattaaagccgattttttagtagaacttttgcatcagaaacataaagctggtcagagtctagatgttaacgaacaagctgtgattcaaaagatgatggagcatagtgacaacgatgcggctactaatgtttataatcaaattggtggatatagtggcttagctaggtacttcagtaatgttggaatggatggatcggtagttttgaccactggatgggcgttgacggctacgacaccgcttgatcagattaaaacacttaatataattttttatcaaagcaattatattagtgatacttcaagaagttatattgaatatttgatgggtcatgtagctgaagaccaaaactgggggatatcagtcggttctaagcatttttgtttgaaaaatggttggaagcaaatgccaaacggtaaatggattattaatagtatgggacagattggaactggtcagaatagctgtacgattgcgataatgtctactggaaataaaacagaacaaagtggagaaaaattagttgaagatctcactaaggcggttagtagcgaactaaaaattaaataaaaaataaaagaaggacgtcctttagggatgtccttcttttatttttatatgtttaattggagatagattccaaacggattaaccttgtccatagataattactggttcatctacggttgttttttgatatagtttcaccatatccttaggtggaacgttgatacaaccgttagagccatgattgtaacgctgactaggattaccaaatacagaggcttgtacccatggagcggaatgaacaaatatcccgtcatcggttaaattgtctgcttgtggcacataagatttatatggttctccatttttttcataacctcgcatagttataggcgcaattttgaatttaatgaaataagcgcctgttggggtagcaatattaatcttgggagatccagtgttaatccgaattttttgcgccactgtttgattttgtactaaatatagtcgttcatgcgttaaatctatttcgatatgatcggaattagctatttttttatgccaatttttttgatttagcgtttgattagcctgattgaagtttttagctgaaacattattttttcctgccagtaaactttggataagatgttgtgcttcactatccgtatttaaactccaacctagagtgccctcagcgttactaaaagatacctgtttgccttggactgttgtaaaggttaaattttgtgctccagaaagcgtgtatttatggttaaaacgcttaatgaatttataggcgggctttaagtcgattgatggaccatctttactaatcgttccattttctattaaatcacttacttgaccagtaatttggtgtcctttagctcgaaacgtaaactgattttttaatagtaatctgatttttttagccgtggtttttccactccatgtttcagaaagtaatggggcagtaatttcaacatgtttattaggtgtatttaaaagtttatcactaactttttccacggtctgatttaccaatatctgattaccagagtgagcggacaataaagaaacttttccatcttggatcattacttttccattttgaggcatggtccgtgaagcattaattgcttctaaatgtttttgtaaagacggttgatctgtttttatagcagaaagcagggcgctttttttatataaagttaaagctttaaattgtttggtactatggttaatcgaccaccatagtcgattcctttgttcagttagtcgatacttcaattgcgtttcataatcggtaactggaatgttattaaactttttactagctaacaccttcttgttttggggatcgttaatagtataacttggcgtcacccgttggttctcaatttttttaacggcctcttgataattgaggtggctaatattgatattatcaatcgtggtatttgtccaaaaatgtgtcgattgataatagagttgttgaattattagaatacctaatattaagcaagctattcctagtacccatgctagccgatgttttttgttgatttgcattttactggcttctttctatttcacttttatttcataaatattacagcaatgctacatttttgtgaagcagttattacgaaatccttgataaatttttaaaattaattaatacgtaaatgctttagaaggacataaaactattatttaaatgcaagaattaaaataacgtttattaaatatttacaagtactatggcaatatgacttaagtttatcagcattaaatgttgcttttttgcgacaaatgtattaatctaactttattaacttacaaaaagtaagtaagtggagggattaatcatggtaaacgtagataaattagaatttggaattgaaacttttggtgatattgttgccaatgaagatggtagtttaaaatcagccgctgaatcgattcgacaaattgttcacgaaggcgaaattgctgataagtatggaatcgatgtgattggagttggtgaacatcatcgccctgattacagtgtgtctagtcctgaaactgtcttggctgcaatcgcatccgtaactcaaaagatcaaactagctacagccgtaacagtcttaagttcggatgatcctgttcgagtttatgaacgttttgccacactggatgacttatctaatggacgagcacaagtgatgcttggtcggggttcctttaccgaatcatttcctttatttggatatgatttaactgattatgatgatttgttcaatgaaaaactagaactatttgataaattacgtacagaaaaagccgtaacatggtcggaaaaattccgagcagctttaaaggagcaggaagtttatcctaagacagagagtggtaagctggaaacttatattggaattggtggctctcctgaatcgattattcgtgccgctcggtttggttataaagttataattgccattatcggcggccaagctgatcgattcaaaccgtatattgatttgtatcacaaagctaaccaaaaatttgggactccagatctaccaattgcggttcactctcacggatttattgcagatgacaatcatgaagccgttgaagtagcttttaaaaatattaaagcgaattttgatcgaatcggacttacccgtggttgggctcctatgagtcgtgaacaatttgatagtgaaactaaagttggttcattttatgtgggtgatcctgaaacggttgcgcaacgaattgctcggaccatagatttacttaatttaggtcgctttgacttagtgtatggtgctggtaatcagaccgctgcacaacgtgagcgtatgattgaactatatgccacaaaagtcacccctagagttaaagagattttaaaaagcaaaggggacgcagaataatgaccattaaacgagtcggaattttaggtgccggtaaagtggggattgttttggctgggttagccttaaaggccggctatgaagtacgaatttcagggtcaggttcagttgataaaattgatttaacaattagtactctggttccaggcgccattgcttctgaaaatgccgaagtggtcgctaatagtgacattatcattttagcaattccactaagccgttataaaaatatcgatcctacgttacttaaaggtaaattagtgattgatgcgatgaactactggtgggaaacggatggcattcgcgaggaggtcctagatccaaccttaacttctagtgagcaagttcaaaactactttaaggacagtactattgtcaaaacgtttaatcatatgggataccacaatcttcaagaagaggctttaccaaaaggtgatcctaaacgcaaggctttgttcgttacgggtgataatcatgcagctgttgatgaagtaacaaaatttgttgattcaatgggatttgaccaagtggttcattataagctcactgatggaattatgactgaacctggtagtccactgtttggggctagtctaaaatatcaagaattaaaacaagttattgataattttgaccatattgactttggacgtaaaattagtagtactttgaattgaaaaaaactaccttgaataaatttcaaggtagttttttatatatcttccagataagtctgttaaagtaataattatttttaatcgagagctagatatattgattgaggaaatttaaaacagtaggatatacgatttctaaatatccttttgcatgctgagtaccaggtaacatccattccacgaagggaacgtttttactagttaaaatttttgccatttctaaaacaccacttgttggcacaaattcatttaatgagtttgctaaaaacatcggtccgggttgactgttgacatgtttgtagggggttgctagtgaatattgatctgagtttccgttaaaataattagtaacaaaccatttataaaaagcgtcgttttgaccagtctggtttatttcagaacttttggaatttgtaaaatcttgtttatgatcaggttgagcaattacggcagtatgctcatttaaccaatcatcaatatcaagaattccagacaaagaaacaatcgggagtccatatttaattcccatttcgacagccatgtttccaccagcagatgagccaactacggcaattcgatcactatcaaacaattttgaagaagttttaatccagtgatataaagtatccatatcatctaaaggtgctggataataagcgtctggagttagtcgatagttaggaacaataacggaaaatccgtcccttaccaaagcttctgctaaatcttgatctttagttttatcacctctaaaccagcctccgccatggatatcaataatcaagcccttggaagcattatcaggttggtataagtcagcttttaaagcatgaatttcatcgtaaattaaatcattcttaattttcattacgttccttctctctagttatttgaaaggtttggttatcactctaaaactagtctaatttagttgtcaaaacaggtattagtttaataatcaattcatctcgacgccagtttattacaactaatgagctttttcaaagattaatacttgcatttaattaacgattaacttacaataagtaagtgaaatagcaagtagaaatctgttactattctgttctttgctatcagtaaattttagaatagttaatcttaaaattagtagtgatttggatgggggcatatattatgacaatgattaatggttatgaacaaagtgatcgtgaagaaaaaattgacattttaaatttggagtctttggaagaaagagccgaaaagattattccaactggtgggtttggatatatctctggcggttctgaagatgaatggactctccgacaaaatcgaactgcattccagcatcgacaaatcgcgcccaaagctttgagtggaattgaaaaaccagaactaaatacagaaatctttggaattccattgaatactccagtgatgatggcgccagctgcagctcaaggtttagcacattcacaaggtgaaaaggatacagctagaggccttgccgcagtaggaggcttaatggcacaaagcacatattcatcagtttctattgctgatacggcagctgctggtgaaggtgctcctcaattcttccagctttacatgagtaaagactggaattttaatgagagcttgctagatgaggctaaaaaagctcatgttaaagcaattattttgaccgtggatgccactgttgatggttatcgagaagctgatattaaaaataagtttgcatttccacttccaatggctaacttaactaagttttccgaaggtgatggttaaggaaaaggaattgaagaaatctacgcttctgcagctcaaaatataagacctgaagacgttaaaagaattgctgattacacacaattacccgtaattgttaaaggaattcaaactcctgaggatgctattcgagcaattgatgccggggcagccggcatttatgtatcaaaccatggaggccgtcagctaaacgggggacctggatcttttgatgttttggaagatatcgctacctccgttaataagcaagtgccaattatctttgatagtggtgtacgtcgcggttcagatgtatttaaagctttggccagtggcgcagacatcgtggctttgggtcgtccagtaatttatggattagctttaggtggtgctaaaggggttcaatctgtatttgaacatatagaccatgaacttgaaattgtgatgcaactagcaggtactaaaaccattgatgatattaaaaataacccattactaaatatcaaatattaatctaaaaaatcctccaattttgggggattttttaggtatcgaggaactgttttgatgtgtcggctactagatactgatggatatttattgacttaatagccaaatgttataattgtggtataaaaaattgataaaaaggatgcaatttattatgaataaagaacgctttgaggcttttacggacgccgtaattgccattataatgactattttagtattagacatacatctacctacagatgatcattcgatgcgagcgattattgccattgctccttcatttcttgcatacatcgttagttttacaatactagcagtcatgtgggttaaccatcataatttatttcttcatgtgaaaacagtaaatcataaaattctatataccaatatatttctattgttttgggcaactttattaccagctaccacagcctggtttggttcagacatctactcatcaacggcagcttggctgtacgctgtcaacgtcattgtttacaacatttctttctcaatggtgagaaatgaagttttaaaaatcaatgataggttgaagcatttatacattacagagatagcatcgctgattttaaatattgttgcattgtttattgtattcttctggcctccctttattatgataagtttgttaatggacattctactgtggtcgattcaaccggtggttcgtcataaaggataaggtgagctattgattaatgcttaaattagttgtgttctaataaaattgttaagataaaaaactccgcgctgttattagtgagaataataacagtagggagttttttgtaattaaatcatatttgatgctcataaaaatatgccccgacaaaatcgaaaacatatttaacgactcttttaaaataaatttttctcagaaagttcgttgatagatttaacgcccaacagtaccaagaggctctttagttggtatttcatctgctcaatcatttcaaccataaatgcatcgtcatggtggagtagctgatggaggaagtagcccgcaattcccacgttatcagcccctaaagccagacttttaataatatcacttgaattacgaataccgccagtagcggtaattgacaagccatcaaccgtaattgatttaagtgactctaccgttgttaaaccaaacgatgtcataaaatcaaaatctttagtgtgacgacgagcattttcgatttgaataaagttagtaccgcctcgaccaccaacatcaataaactttacgccaactttttttagggcgagggcatcttgatgagtcattcccgcaccgaccgctttaacaatcacgggtactttcaggttagaaacgatttcagcaatatgatctaggtaatcaaaagtacggtcaccctcaggcataactagctcctgagcaacattgatatgtaactgtagggcgttcgcttgaagcatgtctacagctgcctgcgctttagcaacactagcatccgccccaacattcgccataatcaatccttggggattagtttctcgcacaattttaaatgtgtctgctagttcaggatattttaaagcgactgattgagagccaacggccatcgctaaatcagtttcttgcgcaattttagcaagccgtgcatttaatttggcggtgtaggcacttccacccgtcatagcctgaatgaagaagggaaggggcatttttagccctgccagggtagtttctaaactaacctctgaaattcccgtttcaggtaatgcgtttggtaataagcgaattgtatcaaacccagcactggcagtcgggctgtaaaatttttcagccaatgaaatgtgttcatctttacgatgagaatgaatatttttcatgacaactcctaattaatttctgtgacatggtgaacatctaaatcaaggggtttgatattatgtttctcccattcagcaaacatttttgctgtcttcgtggaattgggcataatgacaatgccacaatcaccaccaccggcaccagaagacttagcagctccatcaaatttttcagcaatatcgcaaaagttggtaagcgtcgtggtctcaatcgaaacgccactaaataagcttaactcttgtaataggtgccgattgttagtgatctcacgttgaataactgtaatatcagcatcacgaaaaccatcaatcatcttattgatacaagatgcgcttttggtcaaaaactcatgatagctatccgtttcttgataactggttgtagcaacttgatcaactaaatcagaagtggaggccggggagcccgtccaaccaatataaaggcgtaaatctgatggaggagtgagtaattcaatttttaattgaggccaaggcgttcttaaaattgtttctaaatctttagtacgacgcatactgtttaaccagtctcgattgaaagattggtaagcaatccaaccgccataaacgctagctgcaatatctcccaaagaaccgtttccttgcacatctaaatgtgcaattgatgcaagtttgaagagtagttctttagttaacggaatattataaaatttggccacaactttaatggtggcgacggttacggccgcagaacttcctagaccatattttttaccatcactgctgtctaaatcactattgatgtataaattataagtttttaatttacgattaagcaaaacagctagttcttcaataatcgaaatagctgaaaggatatagtgataagggttgtcccggttatcaaccactaattcactaccacgacgtcgccaggaaagaacattattttgatattgtttagaaataatatttccgacggttaatttactaggttcaaggctggcagtgacgaattgattaattgccactagcacggcattattgccaggttcgacaatggcatattcaccagcaatatataattttccgggagctttttctgttatcaatttaaaattcctcttagtttttagtaaatttaattccactaccaggcttagccacgactaattgatcttgatcaaagtagctggcaaagaaccgcttaacccgcgtaatgtttttagattggcacagaactttaacgttgggtccagcatcaatggtgtagtaacactcaattccactttcacgcagttgttcaaccaacttaatcgcttgaatggtttcaggtgcaaaataggtaaaagcaggcttagaagataaagtcgttgcatgcatcatggctgcactgtgttctgccaattcaccaattttagtaaaatcattgttttgtacagcactaatcatttctggaattgcttggttagtagcttccacccacgcaggatagaaaggcgaagtactagcggtatgttgcattcctagcgtacttttaactttcttttggcgtcgatcaatgacgatagtaaccatatttaaatcaattaggtcttcagacacaatttgttcggcaaaggaactttgatgatcatatccgcgatgccaatgcacaattccgccgaaaactgagcgcgaagctgaaccggagcctaaacgtgctagtcgtgagagattagttaaatcagtatgtgaacctaaagcactcactgcggccccggctagagcagccatgcctgaagctgaggaggctaagccagcggcagtaggaacgtgattttcagattcaattttagcaaaaccttgataaccaaattcacttttaaccgcttctaggacgcgattaatacgttgcatctttttaacatcgattaattgatgatttagataaaaaagattactagtgtattcatccgaaaaggttaccttagtatcggtataaaatttgtcgagggtcaaagaaatactgtcattagcgggtagaattaaatccgagttaattttaccccaatatttaagtaatgcaatgttagtgtgggctcttgcaaaaccatgtttttcattcatacgtatcgaaacctacttttaaagtttttcaatccaagtggccgtggctccgccagcagtaagttgctgactaattttttcagcagctggaaggttaggagcaagtgaaatcacacatcctcctaaaccaccgccagttaatttactgccaagcgcacctgaatcattagcaattttaattaatttttcaacagcagggtgactgactcccaattgacgtaagttagtatgtgcttcagttaaaattttccctaacgtacttacatcattttgacggaggacagtcgcagtctgactagtcaattctcccaatttttcgattaaaagtctactgtcagagtcaaatcgaagcttatttttaacgatttcgactgcttcactcgttttacctttaattcccgaatcactaattatgaggtaagcgtcgacgttgattggtaatggcttaatggtaccatcttttttaaaccagattggattattagcacttgcagtagcggaatctagcccgctaggctttccgtgaataatcttttctgaaatatcgacagtttttagaagggtcgttcgcgttaagggatgttcaaaatacgcgtatagggcccgtactagagcaactgctgtcgatgctgaagagcccattccgcgttcggctggaacatcactatcaatggtaattaataaattagtattggggcgattaagctcgtttaaagtttgtttaattagatttttaataccaagtagattactatggatatcatttagagacccattaaagtagcggcttttgatttcaatgtcgccattagttggttggattttaaccgtagttttaacattacggattggtaatgcaattgcaggctgtccatagacgacgctatgttcgccaattaaaattatttttgaattactactctttataatttcttccacgacgatactcctttttggtccaaattaaatgataccttaaataaaacaattgttctatgtagagaaggtaaacatttggtaaaattaataggtagataacaaagtggagatgtgaaatgaataaaacaaagtatgccgtcgttgatttagaaatgacaggtagtgatttcgatggtgacaatcgaatcatccaaatcggatgcgcttttgttgaaaatggaaaaattgtggatacctttcaaagtaaggttaatccgcaaagaccgattccagcgggaattactaaactgacaggaatcaccgatgagcaggtgcaaaatgcccctaaatttaatgatattgtagatgaagtatatcgaaaattagtcgatactgtttttgtagcccataatgtagaattcgattttcccttcttgaatcaagaattggttcgtagtggatatcccgaacttaacattccagctgtcgatacggtttccctcagtcaaattgtcttttcatttaccaagggttaccggctacgtgatttaactagctatttaaaaattgaacatgatgatccacattccgctgatagtgacgccattgctacagctaatttgttaattgcgatcaaaaaaaatctccaacaacttcccattgtaacgttagaacgtttagtggagttaggaaaagacttaccacgccaaacgctatcgattttaaaggacgctctacatgagaacaaacaaaatccgcaaaaaattgatgttgatttaatggtggtcgatggcgttgctttaaaaaagccgattgctttacaaactgaacaccaagcagacgagaaattggtttatcctcggggaaaacgagaaaaggaacagttatacaatggaaccttaagctggcgtaaattacagggttcaattatgaatttcacccatcaacagttttcggttacggaaggcttcaaaaagcatgtggttattgaagctcctaccggatctgggaaaaccttgggttatttattcccattgagttatattgcacgtgaacaacagcgtaaagtagttgttagtatacctacaaccattttacaaaaccaagttctagcagtaggacgtcagcagttaaatgctattttagaaacgccgatgcagtttgcaattctgaaagggagtagtaattatcttaatttagaagccttcatgaaaagtattacccatcaaacgttaagcaaagattctcgcttggtggccatgaagattctggtatggcttactaagacggatactggtgattttgatgaaattaaccaccatattaacttttctaacttcgtcgatggcataagacatcatggaaaaaccgtgcttaacccgaaatctaagttctttgagtatgacttttaccgtagagcgatgaaaaagctgaagtatgcagactttattattaccaatcatcgttatttagcattacacgccgatgaaattggagaatctgatcaacaaccattactagtgattgacgaagcccagcattttccaacgattgtttccaatatgaatcaaaaatttctagacttaaacgagttgatgatggaaacccatcggttagttagtcgtttagtaatgaaccataagcgcaatttaattcaagcgactaaacatcaacccttagctgggtttcatattcggcgctttgttaacagtctcgagcatattaatactcaaattacggagattcaacaaaagctatttgataaatttgtggctcctcgtaagaaaaattcatatgaaaaccaaccagccgagattgtcattaaaaataatgttattaaccaaatggctaagcacgaatttcatcaagtggttcaggaattggccaatacatttattgagtttgatgcgttagatcgcttttttaaagaccaagaacttactccggaaattagggatgattgggctcaaatcaaagcttttcaaagtaatttaacgaaattctatgatgctattcgagaaattactgatcatctcaatcaaaatatttactggatcacgctaggtccaaatcatgatccgggaagtattcggattggtaaagaaattttagatacgggagaattctaccggcaaaaaatcgaaccattttatcataaggttcttttaattggtggaacgctattctttgaacataagcatagttacttcttagaccaatttggcttgcataaacccgagacatcgatacggactttcagacgcggcgtggacttcgaaaaccagttagattttgaagtactacaaagcgactttacgattgattatgaaagcaaccaggatcaatatgctgactttttggcagaggcaattgaagcgttgacgagggatattaaccgtcaaacgctagttctctttaattctttagaaaccttgcgaaatgtttataataggttacatgattctgatttaaacgaaagtcgcaggattatcgcgcaaggtatccatggttctaaagcaaaaatcattcgagagtttaacgatgaagaaaatgctattttgtttggagcagcctctttttgggagggagtcgattttccaggagatcgtttggaatatttaattgtgactcgcttgccattccgttcaccggaagaccggatggttcaatttgcacgtaagaataagcgctcctcctttatgagttttgtcttaccagatgccttgttaactttcaaacaagggatcgggaggttgattcgtaatagtgatgatacaggggtagcagtaatgttagataaccgtattattaataaagattatggtaaattgtttattaaacagctgccaagtggcgtaaatgccaatttaggtaatattaatgaagtcaaagaaagagtgaataatttctttaataatcaagaatagctttctttgaagctgacttttgatatataatcattttgttagtgttagacgaggggtattatggcagaaaaaaataataagcatccattttggttaaacgcctttattgtcattgcaacggttgtgggctcaatatttattatcgtgcaagaaattaatcgaccagagcgctatgacagtaaggtagcaaccgaaattgcaaagaaaaataccgatttaaagaaagtcgatcgagtaactcgatttgtatataatcaggttgaatatacggtctctggaaccaaggctaatggaaatagtattttcgttgtgcttacggataacggcaaaaaggctacagtctatgaccaaacggcaggcgtaagtgaacaaaaagccatcgctagtgttcaaagtgatcctaatctgaagaaaattacttctagtcgatttggagttattaaaaacaaaccggtctggatggtttcttatatcaaccaaaaagatagattagttactaaaacgattaactttaaaacgggtgaagaacttaaaaccattacaacatactaataggaggaacaaatgcaagatttacttcttagtcttttagaggacgggagtatcagcattgctaactttttattagataactatgcaaaactcggcatgacaaatgacgagtttttgctttatctacagattaaaaaggagcaatcacggggaaattcatttcctcagatggataaacttgctgatagcctcggaatgactagtcaaaacctcttttcgaccatccaagcattacaagacaaaaagattctagaaattaaacagcgaaaagacgaccaagggcggttaaccgatttttatgattttagcctgctttatcaaaaaatgattgcgttatttgataataaagtagaagaaactgaaaaggtggcgaccgctaagcaggaaaataatatctatgatcaaattcagattgagtttggtcgacctttatcgccaattgaaattgaaaccatttcgcaatggattgataccgaccatttttcttatgatttaatacgtttagctcttaaggaagctgtattaaatcaagcatataatttaaaatatatggatcgaattttgttaaattggcaacaacgtcacttaaccactccagctcaggttgaaaatagtttgaactctcgaccaactagtcaggatacgagttcatcgaataaagataatcaaaagaagcatatccaaattccactggttaaattaactaaagacaactaaaaaagatcatctcaatcaatgagatgatcttttttagttattcagaatcactagcagagctagtagaagttgttgaagcagaagtggtaatagaagtgctatcacttgtcgtatcattactgcttacgttagagctataggatggtgtgctggagctatcttcagaagaagtatcgttgctgctactatcatcgtcgtcagcatcagaactactataacgactactataagaagagtttgaatgcttgctagaataacttgaccagctactgctactgttgttcttagagtattcatcactcttgccagtctcatcataatcttcaccaatttgataatactggttagtaccttttttaccaactgttgaaggcatggtccagtcttcgttggaagagtattgagataggtaataaatcatatacttccaataatactgagctaactcagtttgtgattgagttaggtaaccagtcgaagtatttggatgatcataaccagtccaaacagctaacgagtaatccttggtataaccagccatccaagaatcactagatgctgaacttggaatgtcatttgcttcggtagctttcttcgaataggctacggtaccagttttagaagccatattcatgccagtaatattagctgcagtaccagaaccttgcgagtcagttgtgactccttttagaatcgatgttatcaagaaagctgtagccttactcattgcacgaacacctttagacttgtaggtataggttttaccgctattagtatcaattttattaatataagttggcttatgatagataccatcattagcaaaggcagcataggcagcggctgtttgaagtgtagaaatgtacaacccaattccattattaaggttatagggttccttacttgtaattcctaaaccttcaaggaaagttgttgccttggaaatgccgacatcttgtaaggttcgaatcgcaggaacgtttcgagattgaattaacgcatctcgtactgtcattgttcccttaaacttatgatcaaagtcataaagttttgtgtctgttccaggataagtaaatggagtatctttaacttttcgatacgtcgaccacttaagatattcaaatgcgggaccgtaatccattaatggtttagcggttgaaccagagctacggtcagtttgaacagctcggtttaaaccataagtaacatcaccagttttacgtccaccaatcatcgcggcgatttttccatttttactattgactaacgtggcaccaatttgaagctcatcatcgttaaattgtaccgtttggtcattatttgctaaatcgtaaagtttcttttgagccgcatagtccatgttagtataaactttcaaaccacccttagcagtatcaaatcctttatcagaaaggtcttgtaacacttgtttaatataaggatcaataatcttgtttttcttagctgagttagttgaagtttcatgggtctctgaaagtccatcagagatactttctttttgcgcttctgttgcttgagcttgagtaatcactttattagaagccatggcttgaagaaccgtgtctcgacgggacttagcatacttagggttactaatcggatcgtaattagtaggggattgtggcataccggctaataaagccaattgagctaaatctaatttttcaagcgacttaccaaagtaatacttagccgctgtttgcataccgtaaataccattacccatgtaaaccttattaatatagaattcaagaatctgatctttactatatttcttatcaaccttcaaagctaaccaagcttcttgagccttaactcttaaagttcgatctgatgcgtccgtagagaatacagataatttaaccaattgctgagttaaggtactagcgccttgtagacctaaagaagatcctgtaaggttagcaactgttgctcctacaatacgaatgggatccacaccgttattcttgtagaagcgacgatcttcaatcgaaacaatcgcgttctttaaagtctttggaatcttgtcttttttaacatattcacgattttgtgatcccagacgagttaatactttaccgtctttatcgtaaattacagtggcgttatcactcgataatttagcttccgtgattttaggagcgctttgagcatagtacataaagagcccaccaccgaaaataattatcgctacaaaaactgctactgctgccaacaataacttcttaattaaggaagaatgtcggttggttttagggtgtttacccatttttgaatgttgcgttcgtcgcatgggtcgattttggtactgatttccgttgttcatagataatctccttgctgttagaaaatcgattttttataaattctctataattttatcaaccgcttttaggtatggaattaagggattcatttggtatcccaattgatatccttgttcttcaaataccgaaaggggaatcgattttcgaccaccattttctttactatcccaaaactgaaaaagatctttcgtcttcagtagaaatatcttgttcaattttacaaactttataattgtaaagcaaattccaccaactttctcgcaatccttcatatgattaatttgatgctcatggaaattacttaaaggaaaggaagtagaattggttgtttcctttgcgtcaaaatcgatatacttacctcgatatactccattatagtcagtagtggaagccttactaaagtaagcctctttaatctgtgccgcgctgcgtttaggataatcaaccttcacaatttgaattggtgttggttttttatgaacaacagcaaccccgtggcttagataataagcgttactttcattaagttcttcttctaaggacatacctcttttaccgtaaataggaggcatgctaaccttggcttggctcattttaggagtggttgcttttgacccagttggataattaaatttcaaagatacgtcctcctgttcatctattatactatggtatttagtttgatagattacaaatagtttaaaaagcgtatatcatatagaaaataaaacaaaatttaatattatgctaaatttaggattgaggtgagcgttaatgagtagattatgggtgacagggtatcgtagttatgaattatcaattttttcagaccaggatcccaaattaaaagtaattcaaaatgcactgaaacgaaagttaattgagaaagttgaatctggcaccacgtggataattgctgggccacaattaggaactgaacagtggtcgcttgaattagcaaacgaactcaaaatggattatccagaattacagacagccttaatgtttccatttagtgattttggtaaacagtggaaagaagaaaaagtcgagaaactagctttaatcaaagccaaggtagatttttttgctaatgttagcgaaaatccttatcaaaaccctcaacaattaagaaattaccaaaacttcatgttaaaccataccgatgaggcccttttgttgtatgatgatgaacatgaaggaaaaactaaatttgatttaaatgccattcgaagctttcaagaacataattcatataatgtagaaacgattgatttttacgatttagaagaagaatccatgttatatgaagaaaaggacgaataattctttgaattttttaaaatctttgatacaatgatacatggtaatttgaacaaaagtaatcgacgaggtgcaacgatggacaacattaattttactccaaaagatattttgcaaaaggaattcaaaccaaagatgcgtggatatgatcctgctgacgtggatacattcctagattcagtgattaaagattacgaaaatttcggtaaagaaattgaacgtatgaagaatgaaaatgatcgtttaactgacaaagttgacgaacttaataagcaagtttctgctggtggaactgttgaagaatcagcaccagttagtggagctacaaacgtagatgttttgaaacgtttgtcaaaccttgaacgtcgcgtgtttggtgctcaacttgaagatactgataatagttcacatcgtatctaattcaatttaataacactttgtaaatctcgggtaattgcggttagcatctgctaactgaggaaagtccatgctcgcacaagctgcgacgcttgtagtgttcgtgcctggtgaaaaaataagctggggcatttgctttgcaaatgacggcaagtgaacaagctaaagccttcggtcatgcttaagtagctttgaaaagtgccacagagacgatcttattaagaaattaataagttggaacgcggtaaacccctcgagcgggcaacccaaactatggtaggggagcttcacatctggaattgaactaaatgtgggggcagacattgtctggagatagatgattacccaaatttaaattttcctgagaatttattttggacaaaacatggcttatagagatttacaaatcaggaaagctagggtaaaagttatcttttatcctggctttttattttaactaaaatttataaatagggaagtaaatatgaagaaattcaatttaattgccacaatggcaagtggtttagaaagtttaacaaaaaatgaattaaaagatttaggctatgaagttcaaactgaaaatggtcgggttcgttttgaagggacctttgaagatattattaaaactaatttatggttaagaaccgctgaccgaattaaaatcgttgttggtgagtttgaagctaaaacgtttgatgatttattcgaatctgtaaaggcattgccttgggacgaattgatccctgtggatggagcctttccagttagtggcaaatctaaaaaatcaactctttttagtgttccagatgttcaagctattactaaaaaagcggttgttgaaaaattacgtgaggttttccattggcgtaatcaatttccagaaacaggggctaaatatggtcttgaagtagccattgataaagaccatgtcatgattacccttgatacaacgggtgatagcttattcaaacgtggctaccgtttacataaaggtactgccccactaaaagaaactatggcagccgcattagttttgctaactaactggtatccagacaaaccacttgtggatccattttgtggttctggtacagttttaattgaagcagccatgattggccaaaatattgcgccgggttttaaccgtgattttgcctgtgaagactggcccattgtcgatcaagaaatggtagaacgggttcgtgctgctgcagatgaaaaggccaattacgatgttgaattagacatcactggttacgatattgatcaaaatatgattgatattgcaactgaaaatgcggaagaagctggattatctggaattatttcctttaagcaacaagcagttaaggactttaaaactgataagaagaatggtgttatgattggtaaccctccttatggggaacgaatgggggaccaagagttagttcgaaagatttatcgtcaattagggactgcaacgggatcgctaactacctggagtcgttattttatcacgagtgatttagattttgaaaattactatggtcaaaaagtcactaaaaaacgtaaattatataatggtgctttgagaaccgattatttccaattctggggtaaacgtgaaaggtaggtcttgatagtgaaaattgcggttattggaaatgggattgttggcgcaacttttgttaatgaaattttagagcgatttcctgcataccaaattgtccaatttgacggtattaaagggactgcaacgacagcttctgccggaattattgctccttggttatctaaacgtcgaaataaaaaatggtacaatttggctcgtcaaggggcggaatatatgtaccaaatagcagaaaaataccgaatgcctccagcagtctattttaaaagtggcgtaatttatacacgagataataatgaaaagattagtgcactgctcaccttagctaaggaccgaattaaagacgctcctcaaatggagggatttcggcggattgataatgccgaaatcaaacaactttttaattttatacaaactaaaaataatggagttttagttgagggtggcgcacgaatcgatggacaaaaatttgttgaatttttgaatcagcgcaatcaaacaaagttcgaattacgtaatgaacgagctgttttatcaaaaaatggaacagataccctggttaatggtgaaaaatttgatttaatcgtcttagctgtaggtgcttggctaaaagatactttaagcgatattggcatcgaagccttaactcgtcctcaaaaggggcagttaattgaagtagagcttcctgggcaagcccaagttaatgcaagtgctcccgttttaatgcctgaaggtgaacgagatttcattcctactaaccaaggaactttactcattggagctactcatgaaaatgatcaaggatttgatttaacagtgagtgatcaaattattgatgatttattagccagtggacaacgagtgattcctaatttagataaatcgatggttaagaatacgcgcgtaggaacacgggcgtattctgaggactttgcaccattctttggctatttgccaaatcatccacaaattatggtagcgtctggattaggttcatctgggttaactacaggtccaattattggaaaactattagctgatttagtagaaaatcccgagttggatatgactgatttgactaaaccactgacaacatacattaagtagagaggtacatggtatgaagaaagtagaaagtttttattatcagccagattttttaaataacatgatcagctggtcatggactctaatgattctgattgtaggtattattttctggttagaagtaacaacatttaattggattacggcgactttttttgcattgtttatcgtagtaatcagtgtacaaactgtcagtcgaaccgttgaaataattggttctgagctgattattaatcgggtaatcaaaagtaatttcacaattttaagcattagtaaaattaaaaatgtaacgcaaggcaaaatgtcactaagttttgactatggcaataaaagatataaactattaatgagtcgtaagtcatcagataaattatttaaagctttgacaaaaaaggggtagaagattaatgaatgatattgaaatttcccagaatgctgaaatgttaccaattcaaacaattgctaaacaagccggatttgatgaaaaggtagtcgaaccttatggtcattacaaggccaaaattgatattttttccgagaaaccaagtacgcaacttggaaaattggttcttgtcacctcaattaatccaacgcccgctggagaaggtaaatcgaccgtaaccgttggattaggtgatgctttaaatgacttgacggggtcagcaatgattgccttacgtgaaccctcccaaggtcccgttatgggtatgaaaggtggcgccaccggcggaggttactcccaagtaatcccgatggacgacatcaatttgcattttactggtgatatgcacgctttgactgcagctaataatactttagcagctttgattgacaatcatcttcagcaaggaaatgaactcaatatcgatcctcgaaccatcgtttggcgtcgctgtttagacattaatgaccgcgcgctacgtaatatagttattggattgggagggcgctttagtggtgtgcctcgagaagataaatttgacattaccgtagccagtgaactaatggctatcttgtgcctagcccaagatttaaatgatttaaaggaacggattaaccgtattttgattgccaataactatgatggtcaacccatctttgttaaagacctacacattggtggcgctattgctacgttgctaaaagatgcgattaagcctaatttagtgcaaacccttggtcatactcccgccataattcatggtggaccttttgctaatattgctcatgggtgcaacagtgttttagccacgaaaactgctttacgacatgcaaaatatactgtaactgaagctggttttggagctgatttgggagctgaaaaattcctcgatatcaaaacccctgtcctgggaaagcaacctgatgcaattgtaattgtggcaacggtgcgagccttaaaatacaatggcggagctaaactagctgatttaaaaaatgaagatgtggaagctctccaaaaaggttacattaatttacaacgtcatatcaaaaatatgcaacgttataacatccctgtaactgtttcaattaatcattttattagtgatacagaccaagaggttaacacgctagttaagttgattgaagcggaaggtgtatctgcaattgttaccgatgcgtgggccaagggtggtgtaggttctaaagatttagccaatgaagtgattgccttggctgatactaatcagggaccaatgactaagttatacgataacaatggccgaatcgaagacaaaattaaaacaattgttcaaaaaatatatggtggtagtgatgtagaatattcaccacaagcacttaagaaaattaaagaatgtgtagcaaatggttgggatcatctcccaatttgtatggcaaaatcccagtattcattttcagatgatcctaaacagttaggagcaccaagtgactttgttatgcatgttaacgatattaacattcgactaggagcaggattcttagtcattcaaactggtaaggtgcttactatgccaggacttcccaagcatcctgccgcattagatatcgacatcgatagtaaaggagaaattaccggattattctagtaattaaagttttatgaaatggtttagttatatagttggtttattacttttagtaattgatcagctggtaaaaagcgctgttagtaatcagattgctttaggaactgttaaaagttttattccaggagtattgtccttaaccaatttacgtaatgatggtgccgcttggagtattttatcaggaaatcagatatttttttatctaatcaccgtagtagctttagtcgtattaatctatttactagttacacagcgccagcacttattatatcaatggggattaaccctcatgattacaggaaccttgggtaattttattgaccgcattcgtttaaaatacgttgttgatatgtttcaaattgactttttcaattttccaatttttaacattgctgatatgtgcttaacttttggtgtcatcatattattcattgccattattcgcgacgaaagaattgaggggtagttagagtttatggaacaattttcatttgtggtttcagatcaagaaagtgggcgtttggataaagtagttaccaatcattatccagatttaacacggtcaaaaatccaaaatttaattaaacaagagcaaattttagtaaatcaagcaccaaccaccaatcggtataaagtttcagaaaatgatgtaattgacgttactttacctgatccagtcgaagttagtgtaaaacccgaaaaaatgaatttagatattgtgtttgaagatgatgacgtaattgtcgttaataagccgcaaggtatggtagtacattctgctccgggacatgaaaatggcacattagtaaatggtttattagaccatgcaccattagcaacggttaacggagagctacgcccaggaattgttcatcgtatcgataaagacacttcgggcctattgatggttgctaaaaatgatcaagcaatgctgagcttaagtgcgcagttgaaagctaaaacgaaccaacgaaagtatttagcaatcgtacatggcaatttcaaggaagaagctggcacaatcaatgctccaatcggtaggtctaaaaaagatcgcaaaaaaatggctattgttgaagatggtcgtccagccgtaactcattttaaggttttagaacgttttacggactatactttaattgaatgtgagttggaaaccgggcgcactcatcaaattagagttcatcttaaatatattggtcatccggtagcgggggacccactttatggccctcgaaataccttaaaaggtaatggtcaattcttacatgccaagttattaggatttaaacatccgcgtacaggtgaagaactagtatttgaagttgatccaccacaaatttttcaagatacacttagtaagcttagaggaatttaaaaaagagttataacaaagattgatatttaccaatgtgtcttttgttataactcttttttctatatacttataaaataatgttatattaaggttaggagttccaattactgatataattgaattagtgagtttttgaaagaagaaggaggacttggcgagtatggaaaaagaaattatggatgccatggcaatgaaaagggctttaacaagaattacttatgaaattatcgaacgtaataaaggggtcgaagacatcgtattgattggtataaaaacgcgtggtgtttttattgctaagcgaattgctgaacgtctgaaacaacttgaaaattttgatattccagttggtgaattggatatagctgaataccgtgatgatcaacgtaattcagctgaaccacgttcaactaaagctaattctagtcttgctaaacttgatttaaaggctcgaaaagtgattttgattgatgatgttctctatactggacgaacaatccgcgctgctatggacgcaattatggatattaaccgtccagctcaaattaatttagcggttcttgtcgatcgtggacatcgggaattaccaattcgtgctgattttgtgggtaagaatattccaacagcacaaaacgagaaaattaacgtttttgtccgcgaaattgatgatgaagacgttgttctcttagaaaattaacatgatttaactgtggaggtggctattatggcagaccgatatttaatattagaagacggttccgtttttaagggtaaagcattcggatcgcgagcaaccacctttggcgaagttgtttttactaccgtaatgactggatatcaacaagtcattaccaatcaaatttatcataatcagattattgttttctctgaacccacaattggtgctgtaggaattgatcgggcgagctatgaatcggttgatcccacttgtaaaggcgtcattgttagagatgtagctgcggtttccattaatcgacgtcgccgcttatctttagatgaatacttaaaacggcaaaacattccaggaatttctggaattgacacccgtgctctgattaaaaaattacgttcaaccggaaccattaaaggcagtattatagatcctgttaaggatttggaacatgcttttgatcagctaagagctattgttttaactaatcaacaggttaatcaagtatctactcccaaagcctttccaaatccaggaaatggcaaaaatgtggtagtcgttgatttagggcttaaatacggaattcttcggcaacttagccagcgggattgtaatgtaacagttctggggtattcagctactgcggatagtatttttagtttagatcctgatggtgttattatttcgaccggtccggggaatccgcgcgatttgcctccggaagtgattgagatgattcagattgttgagcgtaatatcccattatttgcgattggattgggacacgaagcttttgcaattgcgaatggctgtgaaattatggaattatcatctgaacaccatggttctaatcatccaattctatctgttatcacagatgaaattatgtacgcctcacatggacaaggatttacggtagaccctaattctgtagatcgtaatgatttaatcgtaacgcattacgatttaattgatcactccgtgcaaggactacgtcaccgagattttccagctttcagtgttcaattctttccagatagttctcctggtccaacggaagctaccgaattgtttgatgaatttatggaaatgatgacaagagggggtcgttgatttggcaagatcgcgtgctaaaaatattttgattattggagcaggaccaacacaaatcggacgtgataccgaaagtgaagcggccgccgttcaaataatcaaaaattttgctgaaactgatcgtaatttattttatgtcactagtgatgcaaattcagtgattcctcgtttagatgttgatgttaaatttattgaagccgaattaacggttaacagcctgatccaaattttacgagaaaatgaaatagatgttattttgccagtggctggaaatacagttgctttgcagctttctgaacaactaaatgaatcaggtattttaaaagaactcaacgtccgtaccatgggggtaacaaccactactattcataatattaacaaccctgagttgatgaaccgcgttcttaaacatattaaagaaccaactattcctactacggttgttgaaaatgtgacagatgcgttaagatttgcgaaaagggttggattcccggttttgattaagcccattgcatctttaactaaaactaaccggattaagtgtgataatgaacatcaactaatggagatgcttgaatcggcattcaaggtttctattactaatcaagttgctgttgaaaaaagtgtagttggctataaagaaattgaaatgattgtcattcgtgacgctgaaggatcaaagcttttaattaacgggggcgaaaactttaatccaattggcgttcactctggagattccattatttttagtcccacccaaacactaaccgacgtcgaatttcaatcgctacggacggctgctctaaagatagctgaaatcttgaaaataaagggagtttgccacgttcaatttgccttggatccaacggatggcaagcattttatcacccggatcaatccctttttcgatcgatcatcggcatttgctgctagggcaactggttatcccattgccaatgtagttgccaagatcttaatgggacaaaacttacgtgaaattaaactttcgggagttcaacgccatgattcattagcattgattgaacccgtgatggatcacattgcagtccgctttccaacttggtcttttgccagctttaaaaatgctaaccaacaacttaatacccgaatgaaatcgacgggttcggtaatggcctttgggcgtagtgcagaagaagctttacaaaaggcgattcgttcagttgattcaactacggcagccgaacaagcagccttagatgaatcccaactaagtgaagcgcaattaattaacgttttgatacatcctcgtgctggagaagtttattacttgttagaagcaatccgtcggggatacaccgttgatgagctggctaagatgacgcatattgacgctttctatttctataagttacgtcatttagttaaactagagcgacgacttagagataatcgttttgacatggcagccttacaagaagccaagtatttcggctttggtgatacgcaaattgcccatctttggcaggtgagatctgatgaagtccgcgattttcgtattaaaaaagctcatgtatttgcgacctataagggtgtggaaccaactgctggagaatttccttacctaactaatacttactattctacttttgaggatgaggatgaagctgttcgaacaactggtaaaaagattttagttctcggaacagctaacagccaagttggtactaatagtgcagctgaatatacaacttttcagacaattcaacgttgtcagaaattagggtacaaggttattttgattaacaataatccgaatgcgttaactttaattcctgatttagcggataaaatctacttagaaccactaaccgttgagaattgcttgaatattattcatcaagaaaaacctgataaaatcatagcccaaggaaaatgggaaattgttacccaattagtcttgcggaatgttcaggtggaacagcttcctgttagtcgaactactcgatcagaaaatatcgaggccgattacatgggtgttatcagttccatcaatggttctatcaacttatttggcgttgttggtattgatgaagataatatgtttattccaattgaagtttcggaagcattaaaagttaaagtagatccgttaattaaaaatgcaaaccagcatattactaataatggtatttattcagttattattaaggaaaatatgcatcagcttcaaattgtaagtgttgtgcctttagcggtgcaagatttaccatttttatcatttgcttttgatcaagattttgctggtataatcatggagattaccttgaatggatcaagtaaaatcgaaaatcatccgataatccaaggtgattatcgctattcacatgtttatccttacactcaatttggtcttaagaaaccgcaaaatccaccattctccttagcaattggtgctgaatttcagtctataaaataaaaaaaccactttatgaaaattttatttcataaagtggttttcgcgttttaaaagtacctaaatcataaatggacgaatcgcctctaaactaggtgtaactttgatagttttttgtccttcgtaaattacaaaaccaggtttagaaccattaggtttacgaatattacggacttgaacgtagtcaacagctacattagcagaattacgagccttagaatagtaggctgcgattgtggcagcttcctcgatggttttttctgaaggttggttactttcaatgattacgtgagaacctggaatatcttttgcatgtaaccagtaaaaatcttttttagccgtcttcatggttaaccgatcattttgagtatcatttttaccgactagaatggttgtatggtcactagcttcaaatcgttctggtttactcttagttggtttaatccgttttttagggttaacttgctttttaaggtaaccttcattttccaattctaatttaatatcatctaaatcttccggtttggctaagtcaatttgagtttcaatgttgtctaagaaattaatttcactttcagttttagcaatttgctcagaaacgtacctcactgcattcttctctttttgatacttcgtaaagtatttttgagcgtttttggaaggggacaattgatttgataaactgattttaattaacttattttcatcatagaagttaggtaactcaatctcagtcatacctcgttcaatctggtgtaaataggttgttagaatttcacctttgacacgataagtatctgcaagcttggtttgattcatagtttgttgtaatttttttagctttttccgattctttttcagctcattacgaactactcgaattaaaacgtgcccccgttgttgaacacgatcgcgttgaaccttttcataataatattgatctaatgtttctgaaagactagcatattggtgaacgttattttcgttaacatctaattgaggtttaacggctgcaaaagtaagctttccggctttgttatcataaataaaaccagtaggttgatcaaacttggctaagtaatcctgaatggtttttaaggaatctttagcgttaaccatctcataggcgagttctaaggctgtttccttaccaaagccctggaaggttgttcgaatagcttgtgcaagtacctcataattagggtatttattttgtaattccatcatcttttcagcgtcagctacaaaagggttgagtaaatcttgggctggtggagtcagatattgggctcctggtaccaacattcgataacgattttgatcagaagaaatatgtttaatcgtgtcaataatcttgccagttgttgacgagtggagaacaatattgcttcgtcgtcccataatttcaacggataaaatcaaatcttcttcatcaccaatatcgttacggtgagcaaaatgaagattaatgattcgatcattttcaacttgtgtgatgtcctttagaatagcgccatcaagatgttttctaagactcataacaaagttactaggcgtagaagggttggttaaggtttgttccgtaatttgcgctctggcgtaattagggtgagaagataataataatgctttgttcttacgatttactcgaatcgtaagaacaagttcgccttgataaggttggtagattttagctacccgaccagtttttagtgtattcactaattcttttaccatggcatgggtaaataatccatcaaaagccatattttatcagtccattctatattaaagtgagatacctaagtataacgttaaaaaatatttgttgcaaaaatacttatatttgtaccatacaagtatttttgttgtataatacaaatataggtttgattaaaggagtgttattaaaatgattggtaatttagaggctttagagatcatcaatcgacaaagatataactttttgaagagcacttgtatggaaaatggtgggacgattgcagactggaaaattaccaattttttaaaagatgatctattgtcggttcaagattttgttgataaaagtggtttagatatctcgacactcagtcgccaagtaaagcgtgccgtagagaaaaaattaatatctcgaaataaaattgaagcggatcatcgtcgaacgctgtttaaaattaccgaaaaaggtcgtcttttaaaagatgaggttaatcgccaattagatatttatgatcaaaaactatttgaaaattggtcaaaagaagagttgtcgatgttcaatattttgattaatcgagttttgaaaaatgccttaaaatagtagtaattagtccgttatagacgagaaattgagactaatttatgttatagtatttgttattgatttaaaatgaagtgggtgtactaatgaaaacagctattgttactgatagtacttgttatttaactgatcaagaaattgcagacaacaatataaccgttgtaccaataccagtaattatcgacggcaaaatctataaagaaggcgttgatattactacagaggagttttatgaacgtttacggacttctcaatcctttccaagtacttctcaaccaccattgggtgaaatgattgaattatatgaaaatttagctaaggctggatacgatacgattatcagtattcatctggccagcacgatttcaggcttcgtttcaagtctaaagagtcttgagggtaccatcgaaggcgttaatctggttgtttatgattcacaaatcactattcgcttaatgggaattctagccttagaggctgctagattagctcgtgaaggaaaagatgttgataccattttagaacgtttggactatgtccgttcgaccttcggagaatattttgttgttgatgatttacaaaatctcgttcgtggtggtcgactttctaatgcttctgcttttgttggaagtttattgaaaatcaaaccaattctaacttttaatgatgcgcatgaaattgtggcctttgaaaaagtacgttctcgtaaaaaagcgatcgcccgcgttgaaaaactttttgatgaagcttaccgctcggctgagtatcctctacgggcatttgttattcatggtaatgatgaaaaatcagccttgaaatggaaggctagcttagaggaaaaatatcctcaattgccaattgatatttcttattttggccctgtgattggaacccatttgggtgaaaaagcgatcgctctaatttgggtaattgattatacaaaggcataaatctgcattcctagataaacaagtatgattccaaatcctaaacttgcacaactgtaaagtagtgcaagtttttttgttgtcttatcttgtcctagagtgactatttcgttagcaaaggtagagaacgtcgaaagccctccgagaaaaccacttattaataacaatttaagcttagaatcgtgaatagtaacggttaagaagccaatcaaaaaacaagcaatcatatttacaataaaagttgaccaaggaaaggcgtgttttttaaatgtttggtttaagtgcgtagttataaaaagacgagcaacagcaccaagggccgtacccataccaacataaactagaatcatgaaatatcaccaatcctttcgataatgtttgagtagtttaccacccagaaattgtccgaaattggctaaaattaaggatagaataacggatgtaagcaaaaaaataatcatcgtcctaaaatgtgctacagtaagttgatttaatagtgctaattcaaaagtggagaaggtcgtgaagccacccatcaatcccgtagttaatcctacgttaatagtatctgaggtatctaacaaggttaatagcccgcctgttagtattcctaggagcaaggctccaagaacattaataagaattagtgataatggaaaagaggggaatcgagcatcaaaatataactggagtagataccgtaagattcctccaatcgcgccaaaaattgcaacgcttaatgatctatttaacaatggttatcagcctttctaatttaatttttgattttccatctaaatttaataagttatccataattatcttgtttaagatttcagtattattacatttaggaagtgacgttaatatagtgtttgcagttatgctaaactgtttttagcagtttaaattaaaaggagctactttaatgtcaacattaatgtttgtacatgttatattatggattttaattggattaatttgtacatatggaattacaattgatcaatttcaccaaacactgattgcacagtattgtgcaagaatattggatatcgcacttattataacgggattagtgaacgttgttcatacagttgcaatgtcaccattgctagtctggattcaatttattctagaaattatcacaatcggactacttgattttacacttattagcaaaagaaataaaaagaatgttaaacctaagcctataatgctatttgttttagtttttgctgttactactattttaggtactgtaattcaatatttgtttggttaatctaaaataaaagccttcttaaaccagatttaaaactggtttaagaaggcttttttgataaataagatataaaactacctaagaaatatgttggtgaaatatgttggtgattaattaacaaatgagaggaggagagatataaaaatggttactttgtatttttctcattctagtttacataatatatattatacaaagtttataataaatcgaataatataaaatagtatttattttaaatattaaaatcacttttattcattcttatatttctcccaaaaaatagcaattcattttaacagacgtaaaatgaattgctatttttaatgtatttatttactagcattaaatgggccgctaataactactttgcctagcatatgtcctgtttcaacatcttttgttgctttcttcaaattaacggcattgatgccatcggaataaactttacttaacgttgtcgttagttggccttcgtccgccaatctagcaattacttttaaagcttgtccttgagtttcaatttgataattgtaatcggttttcgcaaacatgtattcccaatcaaagctaaccgacaaatttttccaatcgctgatatcaagcgcgtcatgaattcctacgatagtcccgacatgaccaaatggattaatcatatgtttaatctgacccaagtaatgagtgatatcgaataaaacagcaatatagtctactttttggacccctaattcatgcatcttatcctttaaatcatcatgataatcaatagggtgatctacacctaatttttctaaccattcgaagttttcaggactcgcggttgcataaatttctaacccagcccagtgtgctaattggttcaaaactgagccgacgccacctgctccgttaatgactaagatttttttgcctttgttagcaccttcttcggggattaaaccaaatttttcaaaaagcagttcatatgctgccaaagaggttagtggcaaagctgcagctccttcatccgatagttttttgggtgctaaagcaacaatgcgttcatcaacggcttgatattcttggttgctaccggcacgagtagttgtccctgcataaaagacgcgatcgccaattttaaacttctcgacttcttttccggtatcgactacctcaccaactgcatcgaagcctaaaactcgaagcgcatttcttttaatactatctttacgcaatttagtatcgatcggattcacagatactgcctttacttttactagaacatctctagattcaagattcggtactatctttttttcgtcaataaaacttctttcttcattaattggcaatccttcaaaaaatccaactgcatgcataaactccttttctaacatgtgaactcctccttgattttatttatctttttatgaattgcatcttttatttaatcacatcataaatatcagataggctttgacgcttcttttcaggtatttcttggtcccgataaccaaagccagccatataagaaacgccaaactcatccaaattgatgatttttttcttttctaaatagttttcaaccgattctttattaaaaccttcaattggcacactgtcaattcctaagtaggccgcagttgttagcatgctaaaggaatgtaggtttgttttgaggcccagtcgaacaatgaacgttcatcagttaaaccaaagtcgtttttttgaaagttattaaaaaatatcgtttgaggcgatgtttcagagtaaggaacaccgaatacatcttccaccatatgtttaacatgagggctattaccggttaagtttttgcgtgctagcacaattaaaaaatgactagctccatataaactatttcgtgctccccaagcaatatcttgtagatcatcttttatttgttggtttttcactaataaaaatttccaaggctcataaccaaaagaacttggcgacaaccgagctgcttccataatcgtcatccaatcttcctcggcaattttcttggtcggattaaaagattttgtcgcaaagcggtgcttgtgaacatatagtatttctttacgtaattctgtttgatcagtcattttttctcccttttaaaactattggattttgcaaaaagtatataaagatatctgaactatagttgatgaaaatttcaaagtaacgcatttttagagaaggacctttcaaaagcgtaatcaaatcatcttatcgctcgggtatttcgttaattaattatcttatattaaagatttaaataaagacttcaaaaccttacttttaggtattgagactaagagttgtacaaattgcaactaccgacaataaagataacgtagaaatccgagaactgttacatttaatgatattattttactttagctggacctttaccaataaaaatacgaaataagctataaggtttttcacgtaagtctttacctttatggaaacctggttggcgttgcaattggttagtattaaagtataagtattcatctggaccaattgacaaagtatcaggccataaaatacgaggatcatgagccaatgtttcgaatgaaccatcagtattaatgatacgaatactattattttcgaagtcaccagcgaaaattgtaccgtctgctgcagtaatcataccatctgaagcccccttttctccccagtctttgacatgtttttcaagttcttcatcttcaatatctttatcgaaaatcaaatcggtattaaataaaggtgacggcttgataatggactgaagtacaatgttttaccatctggtgaaattgcaattccgtcagctgccacttgccacggagaagttgaaccatctgcttcccgattcatcaagattttgccctctactttaggaacgaaatcagaatcaacggctgtagaacgggcgccatctaaaattcggaaggaatcgccagttccaagatcaacgacgatcaatgcacctggtcctgtaatggaagaatcagtgatataagctaccccttctgatcctcgacgcaagtcaatccgtacatcatttaaataagtagaatttagaacaacatcattggcaaaagtatagattttccggatagtattgctttctaaatcaatcgcaactaattttgctccgcctttaacaggaacatcaaagttcggcgcagcagtgtctaatacccatagagttccttcgccgtcagcaacgatactttgaacgcttaaaaaatttttctcaggatttttagggtcaaaagtgttaagttcttggctaggataagcaactagttcaccatccacaacttcagtaacagttgcttttacaccatcgccccattcaggaaagttaatgaaaatacggcctgtttctgtcacactgacacctgttggcatttcatcataaaaagcatgcacttgttctaattcaccaaaaaaattttctgtaggataattcatcatatgtcttcctttctgattcagataaagattattttacttctacctcgaaattcaatactccgcgggccaatacatgaccaaacatagtaaatcctaaaaaagctggggtagaatcttctggaatagcaactgtttctacatttaatgcccaaacagttaagaaatagtgatgcaccccatgtcctttagaggagcggttccgatatatttttttgttcgtgcgtcatttggtaattgaattgccttcgaaggtaattttgaattatccttgttgccagcatcttgtggtaatttgtttactgtagctaaaatgttataaacagcccaatgccagaaacctgaaccagttggagcatctggatcatacaaagtgacaacaaaactttttgtatcacttggtgttcctgtccagctaacttccggtgaaatgtcttgtccaccttcgatgccaaaatcaccagacataaattttatatctgaaagtctaccattaacaatgtctttacttgtgacatcaaaggatggcacattttgcaaacctaaaaatggattattcattgtacatctcctataaaaaataacgttaagattcatcaatggaaatagattaaccccccttgttaaagaagtaaattagggaaattatttatacttccggatctacaccttctttaattcaaaatcccatgattcccttaaattcaattgttcgtacaatttattggtgtcgctggccatcaagctctgtctctcaaaggtaagtaagaaagattggatgaaattgaacacttacttgcaaggtccttaactaagatcctcctaaaaattcttcttttaattttccggcatagcgttggttgtagttttctccccagttgtacagcatttcaatgactggtcttagtgagcaaccatagtcagtgactcgataaaccacctttaatttttttcctgaataacctctcgttcaaccagtttatctgcttctaagtcttttaactgaagggaaagcattcggcgcgtaattcccgggatcgtcctttgaagctcactatatcgtaattcaccatcaaagattaaatggtacaatagaacacttttccagcgtccagagataatttgcaatgttgattccaccgaacaaccttttttacagttgtatatttaggctgtatggatgttaactggaaagttagcatccttttgttatatgccggcttagctcagttggtagagcggcggtatcgtaaaccgtaggtcaggtgttcgactcacctagccggcatttgtttggatgcgccttaatgttaagttaaggcgcattttttcatatacagtctttgtttttaaggcgaaaattatggaggaaatatacaattgaatacacaagataaggatacagcatttcttggtcaaccacgtggattaatgacgttgttcttcacggaaatgtgggaacgtttcagttactacggtatgcgtgcaattttaatttattacatgtattacgctgtaaccaagggtggtttaggctttagtcaagccactgctgcttcagtaatggccatttatggttcactggtttatctagctagtgttgctggtgggtttatcagtgaccgaattttaggtagtcgaaaaaccgtattttacggtggtgtattgatcatgtttggtcatattgcactttcacttcctttcggtggggcggccctactagtatcaattgctttaattgttgctggtactggtatgttaaaaccaaatgtttctgaaatggttggatcactatattccgtggaggatacgagacgtgatgccggatttagtatttttgttttcggtattaatctaggtgctttattagctcccataattgtttcgtgggttggttttaatatgagtttccatgctggattctcattagctgcaattggtatgttctttggattagtccaatattatattgatggtaaaaaatatttaaataaagatagtttatatccatcagatccaattcaacccgatgaagtcaaaaaatttagtcttcgagttttaatgggtgtgattgtattagcattaattttagtggttatgtttgttgctaatgcattaacaattgataatgttgttctattaattagtattattgctgttattgctccaattgtttactttatcatcatgttttcaagtagtaaggtttctaaaacagaacgttcacgtttatgggcttatgtgccattatttatcgctgcaacgttattctgggcaattgaagaacaaggttcagttgttttagcattatttgctgctgatcgtactcaattaaactacggttggatgcatattacgcccgctaacttccagtcccttaatccattattcatcatgctttatacaccaatttttgcatggctatggactaagttaggtaagaagcaaccttcatcacctaagaaatttacgtatggacttgtatttacgggtctatcatacttatttattgctttacctggtttgatgtttggtactgatggtaaggttaatgctctttggttagttggtagctgggcaattgttgaaattggtgaaatgttaatctcaccaattggtttatctgtaacgaccaaattggcacctgctgcatttgcttctcaaatgatgagtatgtggttcttagccgatgctgctggacaagcaattaacgctcagttagttcgcttctacccaggacatgaagtagcttactttatcgtattaggtcttgtaacactagtctttgcactcgtactattaatttgttcaccatggattactaagaagatgcaagggattagataattaaatatttgaattcaagagatgaactaggttatgcttagttcatctttttattttggagggatttatggctagaaaagtaatactttttattgcaatgagtattgataattacattgctgacgatcaaggtgccgttgattggttggagaaaaatgttcatggtaccgaaagtgatgacagttatgagaaaatgtattccaaaatagatacggttattatgggaagaactacctatgaacaagtaacacaaaaattatctccggaaaaatatgtttatgcagatcggcagacgtatattgttacgtctcacctaggggaagatacagatacgattaaatactggaaacagtcgccagtagaattagttaaaagaatccaaaaggagaagggaaaagacatttggattgtgggaggagctaagcttattgatccgctcgtgcaagccaatttaattgatacatatattttaacaacggtcccgatttttttaggatcaggtattcgactttttgatcgattagaggagcaagttccggtccgtcttatagatgtatatcaaaaaaacgaattagtatattcgatttatcagagaggttaatagtttgaaaattgcagcaactagcgacaatcatttcgatgtgaacaaaatagatgaaaatcaaatggctcaaaaacaagccgagtatcttttaaaacaacatgtgggagtatatttaatagcaggagacctatttaataaatttaatcgaagcatgcagtacgtggaaaagctacaggaattagtgggagaacacactaaagtttttttcatagccggaaatcatgatatgttgaacgatatcgactataatcaattagaatcaaatttaagcccattatacttgcataaccagttctatgacgttcctgggactaaatggcgtattattggaaataatgggtggtacgactatacgtttgcagataatgttgataaaaccaccgaacagttttggcgttggaaaaagtctttctggattgatactggaattgaacagcctatgtcagatattgaacgaatgaatattgtgttgaagcaaactgaacaacaaatgcagcaggccagtcggagaaaagtgttatttatgactcactttgcagtaagacatgagtatattcattattccgaagatgcccgcttttggaacatgattaatggaatggcggggagcagaagaatggaaaagttgttggaaacataccagcctgaattggtgatatcaggacatttacatcatcattttaaaccacttgcaaagtctaatggaatatattataataattcagtcggttatcataacaaccgaatcaacgagtggaattcagatgatttcttcactgaatggactcagcgattgcttataaccgatctcaaataattttgaaaaaagtttaaaaaaaagcttgcaaaattattcgagattgggtattattattaagtcggatagataagacgacaacttatatggaagggtagcgaagtctggctaaacgcggcggactgtaaatccgctccttcgggttcggtggttcgaatccactcccttccaccatattgggctatagccaagcggtaaggcaacaggttttgatcctgtcatgcgctggttcgatcccagctagcccaatctagttttcagaaacatcatatcaatgatatgatgttttttgtatctaaatcaataaatcacaggtagttttaatatgtttcgtttttagaatggtattagtaattagttggaggtttatagcttaaatttttaattggaggctttcaatattggcctagttaatgataggataaggagaacaaaatgaaataaccaatggggggctttttttatgaaaattggatttattggtgtaggtaatatggccaaagcgattatcaagggtttgttaaaaaataattttgaaagcacagatatactggtacacagtgcgcatcaatcaagttatggacctttcgcagaaaagaatcaactaatagcgacaaaatctaaccaagaacttgttagaaattcggatatcattgtcatagcggttaaaccatacgtagtaaaaacggttatagacgaagtcagagatgatttaaatcatcatcagttagttgtctcactggcatcaggaattagtatagaagatctacagaccagcttagatgagcaacaacctatcttacgcattatgccgaatgttaacgttgaaattggcgaaggaatgacagcggtcgttgctaatggtgatcttaaaatggaaccatttcagtctggggttaaaatctttgaaactgttggaagtacaatggaacttgctgaaaaagactttccaattttttcagcaattgctggtagtgcacctgcctatgcttacttgtttattgatgctctttcacgggcgggagttaaacatggattaactaaggcttctgctacaaagatcgctgctcaaatggtcaaaggtagcacagaaatggttctgaaatccgatgagataccgtatgccttaattgataaagtatcttctccaggtggtacaacagtagcgggactcctagcaatggaagaagcaggcttttcaccagcggttgttaagggaatcgatgctacggtagcaaaagaaatcaatcattagaatcttgttttttggtctataccgatatataatggatttagattaaaaatttaggaggaaaatttatgagtacagttttgcgtcatgctactatttatactggtttagaaaaaattgaagatggttacattcgatttggtaaaaaaattgaagccgttggtccaatgagcgaatacaaagcccaaggtgatgatcaagttttctatgctggagaaaagattattgttccaggattcattgatgtacatacacacggtggatacggatttgatgccatggatggtgatccagatcaaatcaatgaaatggtaaataaagccgttgttaacgaaggggttaccagcttcttttgtacaacaatgacccaatcaaatgccaacattgaaaaagcaatgcgtggggttgcgaaagctgctgaagataacccagttatccaaggggttcatttggaaggaccatttatttctactaagtataagggtgctcaacctgaagagtacatcaaggatccagatgcagaacttttgggtaaatggaatgaattatctggtggtcgtgttaagttgattacaattgcacctgaacataagggatctgatgcttttgaagcttactgtttagaccatggaattgtgccttcagtgggtcattcagacgcaactcgtgcggaactactaaatagtactgttactcatgcaactcatctttacaatgctcaacgtgagtttaagcatcgcgaaccaggtgtaactggacacgttatgttagaagacaacatttacgctgaattaatttgtgacggcttccatatcgttcctgatatgcttaaattagcatacgaagttaagggaccagaacgaattgacctagttacagattcaatgcgggctaaaggattcgctgaaggtgaaagtgaacttggtggacaaaaagtttacgttaaagacaaacaagcacgtttggaagatggtacattagctggttctgtacttgcatttgatgatgcatttagaaatgcaatgcgtttctttaattgcggaactgctgaagctgtacaaatgagctcagttaaccaagctcgcgaatttggtttggactcaaaaggaacacttgaagttggtaaggatgcagatatcaacgtctttgatagcaaccttaacaaattggaaacatatagttacgggaaaaagttttctaaagaagactaatagtcaaacattataggggtacaagaatgaattcaccggtatatattcaaattcataatgaaatcaaaaaggcgattgaagccgggaaatggaaagtgggagagcgaattccagctgaacgtgaactttctacagaatttagtgtaagtcgaatgactcttcgccaagctatttcaactttggttgatgagggaattttggaacgtaaggtgggttcgggaacctatgttgctagtcagaaagttcaagaaaaggtttcaggagttactagttttacggaattaacggaggctcaaggtaaaaagccgtctagtcggacaatttcgtaccatactagtgaaccttctttaagtgaaattgaaaaattacagttaaatgatggcgatctagtattgcggatggagcgtattcgatttgctgacgctgttccaatttgttatgaaacggcaactattccagaaaagctagttagtgattttagtaaatctgaagtgactaaatcactttataaaactctggaagaaaaagcagggttgatgattggacgtgcggaacaaaccgtctcggcgatgttggcttctgaaaaagtgtcagagtatttagatattaaacgtggcgatgcaattctacgtttacatcaattatcgtatgctcaagatggtacaccgtttgaatatgtacgtactcagtatgtaggcgaacgttttgaattttatttaaatcgttaataaaaaagaaggaagaataggctaatcctatttttccttctttttatttgctttaaaggcttccatcataaaaatcggtaatactatttggcgtttgattcgtttagggtcacttaataaacgatataaccactcaacattatgtttttgccaaaattcaggagcccgtttaacagttccggcgtaaacgtcaaagctaccaccgattcccatccagatcgctggtgcaaaatgacgatatttagcaataaattcttcttgttttggaaaacctgtagctacaaaaactatttcaggttgaagttctttaatttcgtcaataatcggaagggagtctttgaaatagccatcgtgataaccaaccaaattaataccaggatgttcatgatgaactttatgaacaacttttttgattacggcaggtttcccacctaagaagtaggctttagaatgatgttcattggcccactgcatgagttcagtaaagacatcatatccagttactcgctctgtcaacggcgttttcgtgaacttggatgctttaacgattccaatcccatcaggaactaaataatcagcagaacgcacaatttttgcgtaattaggatttttgcgagcaaacatgatgatttccggattagcagtgatgataaaacgattttgatgttgaagaagatcttcttcaacttgttttaaaaactgtgatttagtgacattcagaaaattaaatccgagaatattaacaaaattatatttcataagggtctcctagattaaaaattgcgatttaatgtataaatattttagtagctataaatgctattatatcagtatttgcttattgctttggggacatctggggacgcggataatacttctatcgttttatcctgttcacgagtcttctcttccttaagcatatgggcgtaaactttttgagtaatgctagtatttgcgtgaccaagcctagctgtaacgtagttaattgaaacacctttataaagcagataagaggcgtgtgagtgtctaagtccatgaatagttattggttgtaaatctaacttgcttattaatgaatcaagacgattccttactgtttgacgtctacaatcaaaaataaattctgtaccattacttttaccattgctgatgatactagctaactcgttagttatttttatatcacgaacagaatttttatttttaggtttcccaacagtattcatattcccaaagcgagacttattaacatgaatattattaaagggaatagagacatctttatactgtaaggctagcacttctccaattcgcattcctgtttctaatgctacaaggatcgcaaggctagctttatctaatttagagtgatataaataatactgtaatttttcaaattctgtaactgataaagcgttaatttttttgctacgttctataccatgtggtttaagccgtgtgaatatatcgttcaaaatatatttgtcgtaaagcgcatcttttaaagaagctttgactctagatgtaattatagacatagtacctttagaatgtgttttccctatggcgtctagcctagattgtagaagcgagtaagttagatcttcaagaacaactccatcaaacgatttttttacatgattgagtgttaacacataagttctataagttgatggtctaacatcactttttctgtacgtttccatccagaactcaaaccaatcagcaaatgtcattctggacgctattatgctcttattttgaagcttatcggcttccatcataattgcccagtctttggctgctgtctttgtatcaaatgttttagataccttacgtcgtacaccactctgcatgacggatacgacaactctagttcttttacctcttttttcaaatgatgccataatggcgaacctccgttctcttttcggaagtagccctcaatgctaaaatagacaatataaaagaggactacttaatgtagtttttagggttaagtcacatccatcttacttggcggttaggggatgtggcttttttatttggtgttagcagcatcttcggaacgttgccagtctccttcggtaacgttgtctggagcaccgtacatcatgccacctttagcatgagctgccttattctcagcactatttggatcgtccattgccgattgagtagggctgtctgtcccgttatcttgatcttgtccttttacccagtcgtcttcatttccatatacatcactgcctggtgcatggtcttgatcaggcattactttattacccttagggtcgtaaccctgttctctgtttttttctccttgagttttttgttgtgttgcactcatatttttatttttattactaacttcttcattagtgctatcctgagactgtgaattagaatcacttgatttttcatctttttgagacaactgatcactagcttcatttgcataagccttttttaactcttcaactaaatcattagtaaaatgttttgaactaagttcattgtacttgataatgaagttgtctttactcatatctacatcagtatcagcttcatcatgattaccaatttgaactttaacatcttcttttgatacagggactattaattctccacccaataaattaatagattttccaggttctatcttgtcttcgctggatctatcagattcagtgccccaagcattgtaattagctatcgcttggttataagcatcatcatcgtcatcatcaactgaatcgtaatcggcttggtctgcacttaaaatataaacgtcttcacttgatatagactgctcactgtttccgttcttttggaagtatgtatgagtagcttcatcaatatcatctgcagtcagttgttttttagaggtattagtgaatttccattctacggcaaatgccggtttacctttataagaaagttgtttaaatcctaaaatttccatagttcctttatcaggattgacaatcttattttttgcagcataaacttgctgatcgtcattacttgtattatcttcaccagaatcaatcttttttgatatgctttcaactgatgaagagtctttatcggctttgttattattgccacaagctactaaggcaatagatgctaaggcaatagcgcttaaagtataaaattttttcattattcatcctccaaaaatatgtacagcttttaacgtcaatcagtatttggacgtagggttaattaactttgtaaaaatcatatttctacagtatatacaacgacttttccaattatctttacttcattcatatttgaatacaaataatttataggtttaaaacaaggatcgtttgaatcgggtgaaaaagtaacgattccgtttgttttatcattataaaatctcttaacagccatcccagaatcatcttgaaatacgacaatatcgccatcttttaaatcaaaaaagctatcgtatttttttacggcgattaatgagccgtttggaatgatacgattcatggattctccgtttatataactaataaagatatcttgttctccagcatattttcctaaaacaacatcagataatgttatttgttcgatatcatcttttgtgaaaggatcaacttcagttaatattccagccgacaaacctgcatcgaagaagttatatgaatgttttaattcagtttttaaagaattaggagtcataatcttttcattgagtgagttactcattgatatatcttcgaaagtttcatcttcagaaattaacatttgataatcaattccaaagtaatcagctaaaattctcacgtatgataattgaggatcagctccattttcccatcttgaaatcatacttttgcttaattttgtagaatattttttattaatttttttagccaattcatcttggcttaaacctttgagttttctaaggctttttaaacgctgtttaaacatatgacattcctcctcaaggaatatactatcacaaaaattcctaaaaaggaacaaaaagtgttgactatagcaataatgtttcttatactggtgttgttccttaggaggaacgaaaacgagagtaaaaggagttgaaacgaaaaatgactaataaaattgtttatcacgaattgaaaggatggcttgtttcaaatagcatttctcaaaaaagagtaggcgaaattattggaacaacggctaatgtggttaataagaagatcaatggaactggatccgattttaagttatcagaagctcgaactcttcacgataaattaaaggtgcctatggcttatttttttgaaattgaagttcctttatcggaacataaagagacgtgctaataaatttaaaaaggagtgaatatatatgaatgaattacaaaatttcaactttgaaggaaacgaagtacgaactgtattaattaatgacgaaccatattttgttggtaaagatattgcagacgttttgggatattccagaccagacaatgcaattagaaatcatgttgatgtcgatgacaagcttatgcaccaattcagtgcatcaggtcaaagtagaaatatgttagttattaacgaatcagggatgtacagcttagttctttcaagcaaattaccaaatgctaagaagtttaaacactgggtaacaaacgaagttctaccgtcaatccgcaagcatggtgcttatctgacggatgaaaagattgaagaggctttgctgaatcctgacacgattattaatttagcaacacaactaaaagaagaacgtgaaggtagattaattgctgaacaacaagttaaagaattccagcctaaagtttcatattacgacaaagttttatctaacgacgcactaatgactatcagtctaattgctaaggattatggaatgagtggagctggcatgaataaattgcttcatgaattaggtgttcaataccgacaaggtggcacatggttactatatgcaaaatatcaaagaacaggttggacacactcagaaacaaagatggttcctcgtaaagatggtacagaaaaagcagtgcttaatactaaatggacacaaaagggacgtttaggcttgtacgcattattaaaagataacggatatcttccactaattgaaatggaggacgagtcagcggtgtagttaagtcgataacttaatgaataaataacagaaaaggagaactaaatgaataatctaattgaaaacataaattttgaaattgataaatatatagatgaattactttcagataaaacaaaaacctttactcaagttaaaaatgaattagcgcatgaaaggttttcgcatagtattggttttgaagcatttcttcttgaagaattacaaagcaaggtaactgaaagagctctagatcggaaaattagtgattaatctttacgacttacgattaacggaattggaataatgaatttggaatttagaagggagaaagaaaaatatgatcaataaatggacttttaggaatgaagaatggttcataaagagtgtggatgaaattaaaaaaatcctgtctaatagtgatttgacgtatgaacaggctaagtgtgtgcttagtgagacggaacatcaattaactacaagacaggaaaaaatgaaagttaaagattaatcttgatcagaatcagggtaatgacctgcatatagttctaatgcgtgttcataagcttctgaaaatgcttctaatccaagattttggtcgtaaattttaccaccattagattctttagtcatttctttttggatttcaaccatagcttcggcagttgctgcaccaattgccatatcgtgttcacgttttgagtattgcattattatcaccacctttctattaaaaataattatacacacgaaagaagggagcaagaatggaaaatatatttcactggataataaaaaatcccgatgggactgtagccctcggaatccaaataatatctttgattatatgtgtgccactgcttgtatatatctattttaaaaaatagatatcagtctaaatgtttcaaaatagcatgtgtagcttgacgaatcacttttccatcaggactttctttattatcgcccacatctttcggataactgtcttttacccaatgaaaatcagtaatatcaaaattaagtgggaatgtttgttcaaaaactcgtgcgtttaaatctcgatagataatagttgcttccagtgaatcgttgtaagagttatcgaaaaatgacattactttttgatttggagcaagcgtagttccaactatacttgataatttggttacttcgttgccagcatctaaaggcttgctaaaagttagagaagttattgtagcgggggaattaccaaaattcttaattgataagtatttagaagcggtaaccgtatcaacaaattgaacataaacatcgatgaaaggttctgatgcagtacgttgaattttataagtttgcattatcccaaatgttgaaattataagtgcgattacagaagctatcgcttgtatccaatcagttaattgcattttatctcaccaccttttattgaactaactaaattatacacaagaaatagggaaaataatatgaacaaattagtaattatgaaagaccaacaagcagtgacgactagcttacaagtagcagacggacaaacaacgttaggagcatataaatgacagtaaacaaaaacagaatgtccgatgacaagtatccaatgctaatggacaaaaaaacagtagcagagtatttaggagtttctaaaagttcagttgatgtttttcttttaaacaacaacttgagtgcagcagcttttgaacctagcaagcttaagcgaaacttttttatcaaaacgaaagttaataaatggttggaggaattgtaatgatagtaacagtaagcctagggcaattagcgttttatttaatttcagtagtagtggcaggattaattggtcactcgatgaaaggtggtgagaagtaatgaagttagtaaaaattgaggattgttacgttaatacagatcacattgatcttgttagagaagcagaggatggttttggaaccaaaatttttatgagcggttctagtataccttgggaagctaatttaccaattaaaaaagtactcgacgctatttgcggtagcgaggagcactcggttgaatacgaagatgctgaaagctatagacgagataataattataacatcatcattgataacgacaatggttgggaaagagtgttcggaactaggtcaaaagtattaagtttactaaatcaattaaaaaataatgaaacattaacaataaaacggacaaaataaaaagcctgctactggtatagcagactcaaataaatattcaacaaaggaagtataacacaaatgaatcaacaacagttcgaacaatatgaacgtgaatacgaacaagaacgagagcgtaaggaaattgaagccttattcgggaaggacgaacacaaatgaataatattgatgaacttgaagtggaacgtactaagttagatcggaagttacgtggacttaagaacaagaaagcagaaattgttctatctattgaagaagttcaagacgagattaataaaatcagtcagaaagaacttcaaatgttcgacgggagagagtgccaaacagaatcattcaagtatgtacgaacagctagtaatcctagcaagcctagttggtggcaagtagttaagactgacaatgctaagccaaaagaagtggttcaagtattagctgatatcgatgtgaacctgatcaagcgtgaaccagatgtttcagcgattaaacgttatgtcgcagaaggtcgcttcattgttcgtgaaggtggtcagttaatcgacactgaaacaggaatggtactaccttacagagctaaacgtaaggcagataagttaacagttaaggcggtagaaaactaatgataactaaaagtgcaatgagttttagaaaaaacaaagactggaaaatgattctttacgcaaaggccggtcaaggtaaaacaacatcaattaagtatctaaaaggtaaaacactggtgcttgatttagataattctttcaaagttttggaaggagtttctgacaacattcagcaataccgctttgacaatggaacgccagaaggacgtgagtttgaccgaactaagccgattgaagatttaaatactttcttatcagatgaagatgtattaaaagctggagaaacgtttgacaatttagtgattgataatgtttcatcgcttgaaaaagattggtttgtggagcgtggcaagaattcaaagaatggtatcagcaatgaaattcaagactactcgcaatggacaaattacttttcaaggattatcacaacaatctatatgattccaaatttaaacattttgattaccgcttgggagaagaagatcgacaacgaaacagagagtgggcaaacatttagccagtatgctccagatatccgtgataagtcgctcaatggatttttagggttagctgatgtagttgctaggttagttgttaatcctaagacaaacggacgtggcgcaatcctagaaggcgataacacagtctatgctaagaatcgcttagatgaacggacagtagcaccaattgaagagctatttaactttgacaataacaagacagaaaaaccaaaaaccaaacaagaaaaggaaggtactaaataatggcaggattcgatttagatttttcagaaattaaagatatgaatgtaactgatggcaagtatgaagcagtgattaatagtgtagcagaagatgcaactaagggtggaactcaattcattaatcttgatctaattatccgtaacgatttgaaaggtcaaaaatttggtaatgcacacatcttcactcgtatttttaaatctaagaaaacaaacaaatatccaattggaatgattatgacagttgccaaagcagctggtatgaaagataaaagccactttgattcattggaagactactttcaaaaattatggcatcgtccagtactagtaacagttaagaacgaagaatcagaatacaacggtaaaaaatacgaaaacttaaatgttaaacgttgggaaacttctaagttcccagaagtccaacataagtttaaagaatcaaataaagaaacaggttcaactgatccattcgctaacggtggccaatcaattgatatttcagatgatgatttaccattctaaattctaggagttgagttaaatggcggaagaaggatggatcaaactgtatcgttctatccgctcaaactggctttgggaagatggaaacgaacgatatttaaagtggtggattgatatcctgctaatggtcaatcaccagccaaggaaagttcttgttaatggtgaatttgttgaaattaagacaggtgaacgtttgacgtcaacggtaaagctttctaagcggtggggagttagtagaaatacggtcacaaaattcttaaaacttttagaaaaagatgaaatgattttggcttcaaaaagtcgtcaaaatgggacaacgcttaaagtcctacattacgccgattatcaaggttttgaagataaaaaaagacatcaaactgaacaacgaactgaacaacgaactgaacataaacaagaattaaaagaattaaagaataaagaccatgagaattttgagaagctttggaaattatatccgaaaaaagaaggcaataaaaagagagctgaaaaagcatatcttgaagccaccaaaaatggagtaactaacaaagaaattcaaacagggattgttaactatattaaaaaaattcaagtggaaggtatcgaacgtaaatatattgctcaaggtgctacttggttctttcaaaatagatggactgatgaatatgaacttgatccaattagtaagactactagtgatggtcaacgtgcaggtaagaccgcagaagagattactaacaaagaacaggaacacttaaaagaaatcgaacgaagagcacaggaggcaaaggcaaacaatgaacacagagattgaacgtgaagtgattggaatcttcctgaaccacccagaaaaaacggaaacctcggttgtagaacaagattggttcgtagaaccagaatatcagcatctgttcgaagccgtccgccaaattgaaagcaacgactttctagatatctacggtaaatataatcagttatctagaaatccttttgatttttcatcagttaaacgaatcttgaacgaagcaccaccactaagccaacttagcaacgacgttcaattgatgaaaaaaacggttcatattcgtgaagttaacgaagctgttaaagattaccagcggaacccttttcgtgagaatgagcaaaaactattagaggctttatcaaaaaatgaaacagacgatgttagtgacgatggaaaacttgatgaagctattgctgaattaaaagattcgatgaatcactctagaccacgtggagttaaaacgttcaataagttagatttcattctaggtggaggcatgtatggatcaatgttgttcacaattggtgctagaccttctacaggcaaaacggcgttctctgtaaacctagcttatgaagcgatgatgaatgataaagaagttgaggtagatttcttcacgttggaaatgaacaagcaagagatgctgaatagattcatctcaaggttcactggagtatctagcagtactttacgttctaaagctaatgaaatgtcatcaattctaaaaggattaatcaatcaatcagctgagcagatagctcaatctaaattaagagtgtatgacggattggaaacattaggtgagattgtccgaatgattagaaagaacgccagtaagactaaacaaggtaagtatttagccatcattgactacattggattggtcaaagtaccaaatgtgaaggatagatatatcgaagttggtgaggtaacacgagaactcaaacgattaaccaacgagttcaacattccgattgtggcattgtctcaactgtcacgtggaattgaaaaccggcaggacaaaactccattactttctgatttacgtgagtcgggttcaattgaacaagattccaatgtagtggcattcttacacagaccagaaaaagtagatagcgacagagtagtgcagttatcaattagaaagaatcgtgaaggcgagctagcagatattaactttacttttattggagaagaaatgacgtttaaggaggtttagcaaagtggcatatatggattactgcgagtatcaagccattatgaaagaaaacggatatgttgaatcagaagctgtgaagatatttttaaaacgagcagctgcattcaacaaacgtaaaaaaatatttatgaaacaagaacagttcgatcgcaataatggtgtactgcttgagtacatccataaaactgaactgcagagacagaaagcagtttgggatgctatcgattgtgccgagattgaaaaacgtcaaggattctactttattgaacaaagtggcggagatgaatttatggctgtgatgataactcaatatgagggcgatttaagccgtatgacggcaattgagaaagcgacatataaatactttgaattaatagacgagatgcgtaagcgagcgaatagggggcaattagcgaattgattagactaacaataccaggtgaaccagtgccagctagcagaccacgagttacaagacgtggatttgcatttacagctgaaccatatagaagctacaaaaaaatggctcatcaggcaatcaaagaactgtattcaacagaaccactgcaaggagcactgcatgtacaaattaaattttatcgttcagttcaaaaaagtgtttcaaaagtggaacgccgtagaaggctctcaggagtccatagaccgacgatgaaacctgatatagataatctatttaaggcagtgacagatgcttgtacaggaatcgtatggaaggatgacaaccagattgtaagtactaagtccgacaaattctattcagaagaaccacgggtagaaatttacgtggaggagctatgaattttaaaaatttaactagtgatgaacgtattgtagctaattttattaacgaagctttcgaagagcgtaaccaaaacatgataagcactgttgtttggattaataaccatactaactatctagttaatcagcgtccagacgtacacagagcgatgaacaatttaacaaataggcaatttaaccatgtgatttcagaaatattactaccattttaaaattatgccgtctcaaacggtattaagtacagaatcagaagaaactgacatttaaacataaatatccaatcaagattgaggttaataatcgcatgaaaaaactttcagaaatgacaacagaggatatcatccgtgaattgtatggcaatgattacactttgcaagaattagatcggattaaagaagcacttgaagaacagtatcaagaatggcgtaaacgtaattttaactaggaggaacgaaaagaatgtacgtaattaagaatacagccaacggaagatattaccgaaagctaggagcggaagcacatcagtacaccgatattagatatgctactcctttcagcaagtggaaaaaggcaaaacaaaaagcaaatattttacatgctgcgattagtccaattggtgaacaaattaattttgaggtcaagcagcataagttttacgtgttaaagaatcgaaatgataaaggctacatgaatcaagtgtcatggaatgcaccgaaagaggaagcccgtttgtttgatagtgaagaagacgctacgcgtgaagcaattaatttagctactgctatggcaagagttggtgtcgaacttagttttaaagtagaagaactataatacagcgtcaaaaaaactgaaaccgtgggaaaaacaacggttgtataaaatctacactttattaaggagaagctatgaatattcatttaagaaattttttaatttgtgcattagtttatattactatgacaattctttttaagtggggatatggagaaataagttcgttcccacaatgggttgtttatactatttcatatataggaacgagtgtaggagttagccttactaccgatatatttagtggaagatattagaaagaaagcgggtatcaacgatgtttagattaattggcaatgtgtctaagaaagtatatcacgaagcggaaaatgcttctgatttgaataagtggcgattagataacttcattgaagaccgctacaaaaaaggtggggcagtaagttcgtacgaagctccagaagcaatggtgattgtgaaagctaattctgttaaatcacgaaaagaatacttgaatgatttattggatgaaggaaagtttgaagaatatcgcaaaataaccatgggaaattccgatcgtaatattgaagtgtatggaagtggtaaagatgtaccagaacttattaatcgtcgcaaaaaggttgagaagctattcagacaaggaattacaaataccgctgaaattgcaagtgaggtgcaagcttcaagaagtacggtgaattttgaccttagggcattacgtaagacttatcccgaactaaaacaaaaaagagctagatcataggattacatattaggaggaacgataatgaataatcaagtaacaattttatcgccagaacaaatggcattgaaaattgaaaagtacatgaaagagaatgctgatgaaatcaatgtaatgattgataaaaaaatcaaagcatccatcaaccgagctatcaaggacgcattccaaactacagacagatacggtcgtcaaggtggtatagcagaggaatcgattaaaaaaattattaccgcagaaattgaaaaggcaacaagcgcaatcgtgattgatcaagacgaactggtcgaacagattaaccgtaagctccagaaaaaacttagtaatgtttcggtaaaggtgaacgtttcgttataggaggaaatctaatgattgcaattatcaacgaggattatcaagttaaaatagaggtagaagattgatggacaaaaataagtgtaaatattgttgtgaaccttttaatgatattacgaaaaatatatacagcggatatggagacaaagtggtagctaaaggaattatcgtttcgggctacgatatcaaacacagaaatgttaaatattgtccaatgtgtgggcgaaaattggaggcagaagatgattaaaaaggtattaaaggagatatgggatatcaggtgggtaattatcacgctatttatgatgatttcatttatcacctccacaatacaagattttattagtaaagattatgattctggttttaataatttaatgattgttttgctgattattgatgtacttttgttgatgtggtctcgtgcagatgcagaaaaattaatcggtatccaggatgaaataattaattcacaagacaagataatcaaacaaaacgaaaaatcaattgcactacaaggtgatttaatcgctaagcaatctaaatggattaaccaagttactaaaattgtaaaagaaagcacgcaaaaggataaaactaactaagaatcagcagaaaaattggaggacaaacaatgctaaaagaataccgtaaaatagcaacgattaaagcagaacagtttgatggctcggaagaaatttggagacctgttgcacaatttgaaacagaatacggagttagtagctttggacgtgtgcgaagcttagaacactttgaccagtccggcagattccataaagggaaaattctcaaaccaaaattgaatggaagagggtatttgcaagttaatctttgtgatagtggacggtcgatttacccgtcaatacatcaactagttgcaattgcgtttatctcaaacccctttaattattcagaagttaaccacaaggacgaaaataaattaaataatcatgttgaaaaccttgaatggtgttcacaccaatataacgctaattatgggacaaggaatcgtcgcatttcgagcactcttaataaacctattgccgcttttaagaatggcaagctgattaaggcattcgattctgcaaagaaagctgcagaatggtgtggtgtggaaaacagcacccacattggcgaaagtgctaagaatcaaagaaaaagtgcgtatggatatgaatggaaatatattgaggattcattgctaagaaaaagcacgcagaaagttggaatagacaagcactgggctattgcagatgaaattttcaggaagacttatgaagaggtgaaatagatggtagtttatgtactttggtggcaaaaatacgattctgttgaaatttggggcgtttattcaagcgttgaagaagctaagaaacatataccagatgatgatgttgaaaattatgagtacgagggattcagcattgaagaatttgatttagatgactttgctagttaagaggcgaaatcatggtaaagacaaaacatataatttagggaatacaacgttcacggggaggattaactaatggaaaacgtttatgttgttagattaggaaatttatatttaaaagagtcatcagaattcatgtcacaaatgttttatacattggtaaatttcgtaagtggtgcagagttttacgatgaagatgaagcaaaagaattagcgaaacaaatcggtggcgaagcttataaaattaatctagaagaggtggaataaatgctatgtcaaaagttaagaagagagttagaccaacaaaagaacaagcccaagaacttaatcgtcggctagatgccgttgtgaaggcaggacatattaatgatttgtattgcgattgtgaagtttgccgagcactggcagaacaagcggagctgatgggatataggacagattcgatcatcaaacagcctagtgataagtgggaaagacgtagacgagaagcaaaaagaaaacgtcaaattgatgtggtcaaggtggctaatctagcaggtcaagggttaacatctgctgagatgagtgaaaagatgcatcgcagtaaaagttatattaataagctggcgaaaaaatttgaaattacgcttgctacgaaaaagagaggtaggaaaccgtgccattaataccagaacttgacgagaaaaagactatcaagaatgtgaaacacttttttgaagtagagttcccagcgattcagaatatggcacatgtagcttatgttgatatgaaatcgccagtaattagtggtatgccatcagtacatggagtagacaatagcaatgaagagaagctcacagcacatgctcaagctaaggacttactagctaaggtattgcagtcatgttcaggactagatagagaacatcgacacgtgttggaactacgctacttcaaaaagctaagctgggcagcgattgaagacttaactggttacaataacacacacaactgggaacgattcaatgaagctttattacaattttcgtgggcatttgcggacgttgaagacttaagagtgtttaaagataaccagataaacgaataaaatcggaatgaaatgctaatagtgttcgccttatattgttaatatcgaaagaattgataagtagacacaacatataaaactaataaacgaactattattgatcatttcttttgattgggtgaaatttgggtagtttcaaaagagactaacggttttaagctagcaattcttttcggcaaaaaataataaggaatctttgtgcttagtaaggttcgactccttacagtcttattactggtatgtttgacgtagttggtagctacggataagcaagcacaaaagagtatggcggagatacataaaggccatcataagtcctactcggacaccatcggggacaactaccagatgagatgtggcggaataggtagacgctaattaattcttcagttgccttgtcttggagagaagatagacagtcagttagactatacactaccgtgtgaagggacggctgtcatgtaaggtgcaaatccttaccatctcatagttataacactaaggtcacataacttaattgtagtgtggctttttattttggaggtaattaattatgaaacgaagaatagtacgaggccttaattactttaatgtacgtcctccagtaatagtgtatggctgtggtgaacccacaacgtttgtaggccggaacgacaatagaattatacctaattacagaactgctaaagcatatttatttaaacgtggaggtaaatagataatgaaaattaatacggataaattagcatttaaggtttcgcttgatacagatgatatcgacaaaatcatagatagatatgaacaagataatgctttattgattgtagaaaaaggcagtgcaccttggttatttgtagatggtgagaattatccggttacgtatttatcgtatcaatacttaactgatactgacaaacaaggtgtcaatatagttgttgctgaatatatagatggtacaactgttaagagtattgagttcgataataatacaggtgaagtaaccgaagctaataaataccacttaggcgagtattaacatggcaggaattaaaatgcatcattgctatcatgtcggttgtcatgagttattgccgtttgaagtaaagtattgcaggaagcatacgattaacaagataaggacaccagaagatagcaagcgagataagttttacaaccaatataaacgagataaagaagccaataacttctatcattctaagcgatggactgatacgcgtaactatatagttgctagagacatgtatgtatctggagttagtgcagggatattaaatgataaggatatcattgtagatcatatcattcctttgaggttactcaatggtgatgatagatatgagatgagtaatctatggttgttatctcgtaaggaacataacatcaagactaagttagaacagagtatgaaacctaatcagttaagacatgttagtaaggactggtggattaaagtaattaaggagaagctatgaactcagaagaagcattgacgttggcaaaggacaagtcgagtaagactgcagaaaagtttattgagattgttaatcaagatatcgaagaagcttctaattcaggagtaaccaggattagagaacatgagattcaaggatcaatgctaattggattaatagactatcttgttagtaatggatttaacgttgattatgaagaggacggagacttgaatactgggattgttagttatccaacttactcgttaacaattgattggtcgaatattatagatgatggtgaagattaaaaatgaaaaattaaattccaaaaataaatccaaaaaaattttaaaaaaataaaaatcaaaaaataaaatttcaaaaaaggtcaacaaacccccgccccataggctttctggtaaagagcgaaacgcaatagtggtctctcactatatgctacttttaaaatttttaggatagggggggtacccagtggaaaggagttgatattcgttggctaagaaaccgtataaagaccagaatgacgggcatttgtctagtgatccaccaaagtatctaggaactgaagcaaaggccgtatggcgcaaagtcgtgccttttttagaaagtgaagggaaagtccaacggatggacacttctctggtagaattttacgccacacaatatgaaatttatcgaaaggcatatgatcacatccaaaaaaacggtgaggtcacgcccatttataaatcattacaaaatgcagaaggcaaaattatcggtaaagactttgtgggctggaaaaagaatccaatggtacaaatatatgattcagcgcttaaaagcttaataaagactggttcagagttaggattatcaccaaaaagccgttcagatttaatgcaactaatacagccgaagcagaaagataagaagtcacttgctgagaagcttagagagggagctggtgacttctaatgatcgataaggtagatttgtccaaaggagaggctagcgtctccgaggcagttaaaaagatagattttacagctatattagagaagtaccgtgacccggcaactgtttatgcttggttagtcgttaatgacaagattgtttctggtgagatgatgaagctagcttgctttagacatctacaggacttaagaagagccgaagacccagacgaagacttcccttatcgctacgatttaggacggtgtcgtagtattttagggttcgcttctatcttccctgaaccagcacacggtaagcccatgccactaatgttatggcagaaagccattttgtgtatgagtaaagcttgggtatacaaggataacgacaacttccgttatactcgtgtgatcgtatcagttgcacgtgctaacggtaaatcttatatcgccagcattatgttgtggtacacctacttaatcgaatgttccggactatctaatcaagatataggttatacaatgcctactggtgcacagatgaaaaagccgtgggcttatgtgctaacgtctggaagaattctaaaagataccgaagaagacatacaagaaattttaaacaataccgatacttatattggcgaacagggtattaaatctgcgattggtaacaaagttgttcagctatctaatgagtctggtcaatttgatagttaccattttcgcttggcggttgttgatgaagcaggagatggaggttacgctcacaaacctaacatcggtaaaataactcaaggacaatctcacttacctaacgctcaattattaatgatatctacttcttatgagaacacagaaacgttgttctataaagatcagatacgtttgaaagacgttatgaagaaagactattcccgtgatgaagacagttatttatgtctggtatggcagcaagataacctagatgaaattaatcaacctgaaacttgggttaagagcaatccattgctagaactagatgaagacggtgctatcctaaaacgcatgattagtgataaagatgctcacatagcttctggaattgctaatgagtttcaaaatcgtaacttaaacaactggttgcaggttaaagcaaattcgtatgtaagccttgaagatttagagaaagcaatcattcctagtttcggtattgacaatcgacaggtctacatcggatacgataaaggacaattcagtgatgataacgcaatcgcttttgtatatccttatgaagataacggagtaggtaagttccatgtcgagcaattctcgtttattccgcttaggaattctaacaatgatatcaatgttaaagaacatcaagatggaattaattatcgtgcagaagttgaaaaaggattcggaaagattactgaaaatcaatacggaatcgttgaagatgatgaagtatgcaattggttactgaactacgtagatgagcaccatttacaagttaaggctttcttatatgatttctaccatgaaacgtcaatgactaagaggcttattgaaaatactgaatgggtttgtattccagtccatcaaggagtaagaagccttaacgagccaactcggtttttccgtgacgaattacatcaagggcgtattacaatgctggacgacggaattttgcagtattcacttaagaacgccttactgttcgaagaaaataatggtatcaagattaataaagacaagcgtactagcaagattgatgcagtggacgccttaattgacgctttttttgaagcgatgtattactttgaaggattaagtaacattaaaactaagtccatttgggacaataaaacaacagatgaaattaacgattacttcatgaacgactttagtttttaggaggtggacaattgaaacgaattagatggttcggacaattaatactagcaaacatcagtttaatattaatgattatggctctgactacgtttactgtagcagggtttttattttgcaaatatgttggattggtagtcctaggcttatctctaatctaccttagttggattacagcaagcaggaagggaggtgagtaatatatggcaattaatccatttcctcgtttaaacactcgctcacaaagcttaccaagcggttatatgccgtttacagttacgggcaatgcaattatacctgaaccagttgtgaacgctgatacggctattaataactctgatatcttttcagttatcagtttaattagttctcaattagcgagcattaattatgtgatggacgagccttttaaaggtgtttttaaccatccgaatggcaaaattaatccttatggtttttggacgtcagttattaatcaaatgctgcttactggtaacgcatatgtagcaattcgtagaaaaaaagggataccagtggaacttgaagaaattccatacgcaaacgttcaagttattcttggcgataacaatggtgatttaacctatcaggtatcttacaacgatgaacgtagcagtgaagttattaaatccgatgatatgttacattttcgtatctttgttactggtaattcactttatcaatacgttggaacatcaccactacaggcactaattaacgaactatcttttcaatctctatctagtagattatcacttaatacgctcaaaaacttcattgcacctagcttagctatttcagtacccgaagctcaattgagtaaagaatctaaagaaactattagagacagctttcaagaacagtattctggagcaaaccaaggtaagccagttgtattagatcaatcagctaccgttgaagctatgccaacgattgacgctaagacagctgaatacctgaacaatgtagattggactagagcgcaagttagtaaagtgtttggtattccagacaactatttaaacggtcaaggtgatcaacaaagttcattagatcagtctacaagcatgtttattagtagctttaatcgctacattaaaccgtttgtaagcgagttagaacagaagtttaaggttcctgttaaagcagacctagaccctattgtagacccaacaggttctaaatatgccaatatgatagctaagtttgcaagtggaaaagctcctgttttgagtggtgaacaagtaattaaccttcttcaacgaaagggggtgatagatgatgacttcgaaaaatgatgttcgaagtgttttaaataaagattggcacttacgggacttaagcaatgatgatagtacatctgctattggacaggttactggttacgcttgtgtgtttaatcaaccaagcgaagacatgggatttattgaatattgtgatcccaacatgcttgatggcgttgatatgagtaatgtattagctctatatagtcacgatttatccaatgttttaggtagagtatcggctgatactttagttttaaaggttgatgattacggtcttaaatttacgctgaatattccagacacaactctgggaagagatgtttacactaatatcaaaaatggcaatttagaaggttgctcttttggatttacgattgaagatgattcatggagtagagatacaaatggtcaattagttcatacaatcttacaaattggagagttaaccgagataagcattacaccattacccgcttacacagagactagcgttgctgttagtcgtggattaaagaaagttaatgaagagacacgtcgagaaaaggcgcgtctctttttagatttaacagaaatggaggttttttaatttgaataaagaaaaattagaacagcaattacgggataagacagggcaacttaaaagtttgatctctgaaactagagatttattgggtgccgaagatagttctacagaaaatattgaaaacaaaatgaatgaggtaagaaatctaaagaaggatattgaaggacttaatgttaagctccgtgctttgaatgatttagatgaagatgaacctaagagtgactctgaggggaaaccaaaaggcaaaacggataaaccagcggataaacccaaaagtgagcctgaaaatcccaagcaagacccagaaaaaagggatgaagaaattgatgataactcagacgatgactatgtcgctgaggatgaacttaatgcaaaaaagcaaaatgaagaaaaaggtggtaaaacaatggctacaaacttaactgcaaagcaaaaagaagaaaagaaggaaaaccgtacacgttcaattgaaagctacatccgttctcacggtactgtccgagacactggtttagttactggcgatattggaccaatgattccagaagaaatcatctacaatccagaagcagaagttaactcggttgctgacctatcagcactggtaactaagactcccgctactactgcctctggtacttacccaatcttgaaacgtgctactgctgtaatgaattcagtagcagaactggaagaaaatccagccttagctaaaccagaattcgaaaatgttacttggaaaattgctacttatcgtggagctattccaatttcagaagaatcaattcaagatacgcaagttcctttaatgccagttattcaaaagaacgctagtgaacaacgtttaaatactcttaataaggctatcagtgctaagttagttacgtttaacgctaaagcttcaaccgctgacacagtagcagatgacttaaaacacgttcttaatgttgatttagaccctgcttacgataaatctattgtcgtttcacaatcagcataccaagttctagatacattgaaggataaagaaggacgctacttactacaagaaagcattacagcagcttctggtttaactttatttggtaaatcagtagttgtagttaatgacgaattactaggtaaagttggagaagctcatatctgggttggtgatttaaagcgtgcaattctttatgttaaccgtgtggatacacaaattagctgggttaagaatgaaatttacggtcaatatctcggactagcaatgcgctttgatgtcgaagttgcggataaatcagctggatactttgttacagttggcgctggtacaccgtcaaaatagacgcccctagtggggctaacgtcgtccctactgaaacaggggctttactaagcgcagattaataaaggagatggcttaaataatggcagatagaagtaaacaatcgctagtggtttacgataagtccggtgctaaggttgccactggtggcgttggtaccaaacaagtagaaatcacgggtttagaaggtggtaagcaagttgctaaaggtgattatcaacttgcttacacagatggaacaaatgcgtccgacaaagtggacgttccagcatttacagtattaactggtactgttacaactggataaaggaggcgattttaaatggcggttacagcttccgagttgatggacgaactccatattgatacggacgatgtagaaactaaaacagttcaaggtttaattgattatgcaaaagagattgtaaccgacagtgtaaccgatgatctaacaactgaacaacttgaaacgaagtatccaaaattgtttgacttagctaccaaaaacctagctacgtcgatgtattacgaccgtgagttgactaatggaacgtctaaagggtatcaaatggtaattatccatctatcagctaaagttgctatagacatgaagaagggcagtgatgatgatggcaacaatgaaacttaaaccatctgattttaaccgtaaaattacttttggaaaaacaaaagatgaattagacgaatctggtaacttttatgttccgacacttatacccaaattaagtctgtggtgtgctccgcgaactagaacacttaaccagcaatatcaaattatgaagacggaactagaagatactattatcgtagttattcgtcataatcctaaggttaatgaaacttacgaggctaaatatcgtgatgaactttatgatattgtctcaattagtacagatgatactaaccaaacgtttgcctatgacttcattactcttaagaaagttaaaaaggcaggtgcttaacatcaattacgttgattttatggaacaatggcttaagcaggttaaaaaggtatcgacaagcatgtctaccaatgataaagctaagataactaaagctggtgctaaggtttttaagaaagaattagaacgtgagacacgtaagaaacactattctgggcatgatgataaagttttcggacacatggcagattcagttgtgatgaaaggaaccaatattgacaacatcaaagatgggactagtattgttgggttcgatcactaccatgctagcaatgctaggcggttaaatgatggcactaagtattacgttggtgaccatttcatcacgaaccttagagaacgagtaatgccgaaggttctagaggctgaaaagaaagagtatcagaagattattaataagcacggggaggtttagtgatggataatcccgtactagaggttaagaatatccttgaacaagctaactatgattggctctctgaatgctatgttaattatttaccaaagagtgctcaagatgataccagcagaaccattgccctggtcacttcaatcagagaagaaccaattcaatacggtaataacgtgtttaatggaattgagaatgctgttcaggtacaaatattcttcaagtatcaatttaaagattcaattcaaaagaacgacattaaaattatgcaactgtttttaaagaacggttggaaaatagatgattcaaaaccaatttatgcagaccctgacactaaacaactagtcaaggtcttttattttactcaaaaaaattatataggaggtagttattaatggctacagtaggtttaaagctagtaacactagcactcaaagactctgaaacagggaaaattcttacaggagaaaatggtttatcagaaaacggattgctaccagttacaacacaaatgtggggtactaaaacagctaatattacgaatattcaatcaaccggaactattaattacggtaataacgcagctgtattcgtttcaacacctaagggagcgccacaagtagcgctagacttcaacaaattaccatttgaagtcacacaaaagattgttggacgtaagcaagacccagatacaggagcttggattgaatctggtaagcatccgtcagttgcaatgcttattgaaagcgaatctattgaccgcatgaacaaagtttattacggattcggtaacggatcaatgacacaagcttcaattaataacggaactgatactaacgctgaaacgatggcaactgatgccttaacttatcaagcattgtctacaccagaatttgatggtgaaatgcttgctatgtattccgatgtttcaacagcattcgatgaaactaagatgaagaaacaagtgtttgcaggctacgtagactcattgtcaaaatagacgccccgacaggggtaaacataacccctgaagtaaacggggcactattaaaagctgaataaataactataactcgcctaagaaagtaaacaataccgtaaggggcgggtttttaatttaaggagaaagcaaagctatgaaaattgtaaacatcaaaattaaagaattaggcatgaagaaggctgttaaagttgctcaaagtgtagcaaatacaaaattgattaactcaattcaattgactttgctcaaattgcaagatgatcactcagacgatatgactgaaattgaacaacttgaacatgaggcacaattattgagtgaaattgaacatttcttcaaaaacttcttaaagctaagtgataaacagattgaaaaggcagaagaagagctagacccagaggaattatcgtttgcaattggtgaagctactgcgcgtttccaaggtgctactgacaaagatattcaaaaactccgtgaaggtatgaaggcagaacaaaaagatttagaagaccctttagtagaagagaacgactccgacaaatccgaatagagatttttaaaaaagaacgttccattgataatatgaattacttttataaaaaaatgctgatggagtatcatctattgccaaaagatatagacggacaagattattttgagtttttagaagtaataaatgctaaagcaccagaggatcaaatggtggattcaatggagatctataaacaaaattcttaaagaaaggaggataaaaatatatggcaagcaaagttgattcaattatgagtacctccgttgccttagaaactcttaaggcttctaacagtattaactctttgaccaaagctgttagaggctctacatcggcttggaaggctcaagaagcccaactaaaatctagtggcgattatctgaaagctagtgaagccaagtacgaaggtcttggaaaatctatagaagctgaacgaaagcgtatagaagttctccaagagaagatgaaagacttagatcagaccactcaagatggcgctaaacaggctgtaaaatacggtactgacttagataaagctaccactgccttaaagtccatggaagcacaacaacaacgcgcttatgaagctttgaaacgtgaagaaagtggcataaacagccttaattcatctatgcgtcaacgtaactcgttatcaaaagctatatcggatcgtttagaagccgaaggtaaacatgaacaagctcttaaggagaaacgagacaacgctcgtaagtctattgatgatactagtaaagctctaaaaaaagaagagttcttacttaaagacttggaaaaaaataatggtagtgcaagtgctatcaacaaacagagaatagctgtagaaaagcttaaagcttctatggcagaatctaaatcttctgtttctaagtttgataaatcaatcaaagagttaaacccatctcctattcaacggttaagtagatcgtttagtggattaaaaaaggaaggcaaagaaacacactcaatctttaaaagtgtgttcgctgccagcattattagtagcgcttttactagtacactaggcgcaatctcaatgaaactacatgatatgtggtctaagtctatggattatgctaaagcacagcaaaccatgaatgcttcttggttgaccttgacggggaatgctaaagaaggtcaaaaaatggttaacatgactaatgacatggcggcttcttttgctaactcaactgacatggttaatgacttaaaccagaagttttactcaattagtgattccagtaagacaaccaagcagttgactactgacgttctaactcttcaagatgcttttggtaaaactgatgatgaagttaaaaacttctctacgcagtattcccagatgatggctaatggcaaagttagtgctcaagatatgatgtcgtttgttaacgtctttcctaagattagaaacgagttactaaaaaccgaacagaagatttctggcaaccataatctatccatgaaacagcttaatgatatgatctcaaatggaaaagtatcatcgaaaactatgcaaaaagtcatggatagtatgcagaagaaatattctggtgcgactgctaactttggtaagacatttgacgggatgaacagaacagttaacgcacgtgttccagcattattaagcgcgtttacaacgccacttcttaaggcaaaaaacccattacttggtacagtttcgaagtgggtttctgataagaatacagaaaaacaattttctaaattgggtggtgttgcatctagagggtttggcacaattactaacgccttttcgaaagcattaaatttcaaaggcggattgaattccgacaagatttttaaatcaatttcaaatacgattactagcttagctaacacgattgctaaacattctaaacaaattgttggcttctttaaaggcttatggaatggagtaaaaatcctgggtagtatagggacaggtttctttaaaggattaattggtggtttaagtgcagttgtcaatcctttagcaaaaatggctggacatagcaaaaaagttaaaggattatctggttcgttaggtgaactatctaaacataaacaaggactagaaacactcggcaaaattttggcgggtgtttttattaccactaaaattgcgaaaacagtagttggttttgcaaaacttacgtcatcaatagctaaagtgataaagtcttctaaattattaacggtcgctcaatgggctttagatgctgcaatggatgctaatccaatcggtattgctgtagttgctattggtgcgttagctgtaggcttttatgaagcatacaagcatattaagcctttcagagatgcagttaatggagttggaaaagctattgctagcttcactaagagtgctctaaaagatactaagaaattctttaaagactttggtaaaaattggaacaagttctggggcggtattggttcaagcattggtaaagcttggaaaggtgcaagcaaggcggtatcaaatggagcttcttcattgaaaaaggcctttagtgaaaaagttggtgatattgccgactggtttggggatgtcggtaaaggcatttctaagtggtggaaaggtttttcgaaagcctttaaaaaaggatatgattcttttataaagaaagctaaaggttttttcaaaggactgggtaaagtcttaatttatgcacttgcattcccagttggtctagcaatgattatctttggaccacttgtaaaagcaattggtcaaggaattaaactgttaatcaagcctatcaaagcaatgggtaagatgatttctaaggcgttctctgcaatgtggaagcctattaccaaatacgctcaaaaagcgttcaccttaattaagaatgtcgttcgtacaggacttaacaacttagttggtaacttcaaagcatacggtgcaaccttgtataaggtttggaaagcagtttggaagccactatctaaattcctttccaaaaccctaaattccatgggcaagttgtggaagaaatttactaacatcctttccaaggtttggaactcatttagtaaggcttttaaaaaagcttggaacaaagtttgggatactattagtgatttattttctgatatattcaataagatttctaagaagttcaaatcttggactactgcaatatctaaaacatggactggtttcaagagctggttcagtaaaaagtggaaaagtatgtggaatggtgttcatgatttcttccacggaataactaaaaaattaagcaagacttttagtggatggacttctggagctatgaacactctaggaagttttggtaataaatttaaatctggttggaacggaattgttaaaggcgttaagaatatcttcagtggtttgtgggatgaaatgaaaaagatggcttccgatggtcttaatgctgttattggagttatcaacaaaggtgtaggtggcattaatacggtcatccatacctttggcggtaagaaacaaactattaaaccaattggcgaggtccactttgcaactggtactggttcattaggttctacaagctttagacgtgcgattaaccagattacaccagcggttgttaatgacgaagcaggggcaaacaatccagagctaattttccgcaaatcaaccggaaacgttgaatacatgaaggaaaagaacgctcaaacagtattgttcccaggtgatgaagtagcaaatgccacagattcagctagactagctccaatgctaggcttaactcactttaaagatggtggaataggttcgttctttagtggcttatgggatagcactaaaaaggttgtttctaagattgctggaagtctacaacaactttggaaggttggaactgaaattgtagctgacccagctaaagctttaactaagattatgccgttctctaaaggtggcgctaaaggattcttcccaactatggttaaaggtggtttcgatttcgttaaaaaggctgccggtaactggtggagcaacctctgggatatggttagcttaagcggagatggtagtggttcatacggtggaggctggcaatcaccaggtagtggctggtcacatactgatagttttggttcacctcgtggtggtggcgttcatgatggtaatgatttttctgcaagagtaggaactgcattccatgctatgcacggtggtacggttatccgtgttggtggtgctcccgctggctggggtcctgttggttataacatcgttactcgtgattcaactggtaaagagattatttatcaagagtttggtaacgccaaagacgttagggttcatcaaggacagcatgttaaaactggcgacacccttggtgttctaggtcattctggattaggaactgggcctcatttacacgttggactaaccaaaggtggttcagtttggagtagaaacggtatgagcaccgcaggttggttagacattactaaacaacatggtaaagataaaggatcagatgctgacagtgattccgaatcaagtggcgatagtaaacttcaacagataattaagaaacaagttggtggcggattctggagtaccattaagaaaattgccagcttgtttggtgacgatggtggaactggtgatccaggtggagctggtgtacaacgttggaaatctgacgttaaaagtgcattgagcaagcttgggctttcaaccagtgcaagtatggttagccgagtattacgtcaaatcaatactgaatctggtggtaaccctaaagctatgggtggtactgatggtttagctgacggacatgcagaaggattgatgcaagttaaaccagggacgtttagtgcctatcatttatcagggcataacaatatctggaacggatacgacaatattttagctggcttaaactacgccaagcatcggtatggtagcggattgagtttccttggtaacgggcacggatatgctaatggtggaattgctaatactccatctatctttggtgaagcaggccctgaaatggctatcccactatctatgacgcgttctgatagagctaaccagttattaggtgaaaccgttgttcacatggctaaaaacaacccagacaggatagcgaacggagacaactacttaacaggttcacatgagttgacagaaattaaagcactattaaaagataccattggtaagcttaacgaagtcgttcaggctgtctacaataccgcacttactgaccaaagcattcacaatgcaaataagagagaaacagacaaagtaaattatctaagtaacttagggaaaggactaatttaatatggcagaagaattgcctttagcaaaacattcatttgaatttgatggaatcagagcttatgaagatttagggttggttgttggtcatattaactggccaactggaactacgataactcatagttcccaatcagttcctggacgttacggagaaataccacaaggtaacgcttatggtgcgaagacttggcaaattccagtttcgttccaaacctcatctaatgaagaacacatggaaacactaattaacatcacacgagcatttacgcgcagagcagaacaaggtgtttcatttccaatgcgttttgggactatgccagacgtaacttattatggaacgtttactgctttaccagaagctacacaaatttcagttggaaccaacgattcacaactaaccttgactttcactgcagatgatccaaaaggttataaagacccagttaccgttaaaattacggatagcatgttcgaatatactccagaaggaactggtgaaatttatccaatatttagaattactccaaaaaaggacatggaagaaattggtgttgcttatggctcagattccacaaaatacgttgatgttggttatgatcagactgccgatgaacagggtaatatcgttgataaagaacctgtgctggttagtgacccttgtaatggccttacaacttggacaaacattacagatatctcaaaaattaattttggaattaatggagtgattgatggttatgtaatgagtaatgacaattctatttctgtaaaacgttcacctaataatacaagtgccatgtacgactatggtgatcctctaaaacatacagatggaaaaatgtatggtccattgattatgcaccaagggttgccaagagcagttaaaaactttgaaacagatttcagaattaaccatgtaaagaattacagccgtgccatttcaggcaatgaggtatatggaattgattcaaacggtaaatgtatttttagagtattcatgcaagattcttcacaaggaagagcgacccttggggaaattcaaattgggcctgaaggtaatgctattcaagtctacaaaggctatagagattgggaaaataagaaaaactacactgaccacgtaacaatcgtaaagcaaggtaaggcttctaccaagaacactaaaggtggtaaaggtaaagctaaaacggatgttagttactaccaatctaacgtaaatattaaaaactttaataatacatctttttttaatagtggatttatccaatgcagaattagaaaaattggtttaaaagtttgggtaactttgtggaaatgcaatggcaaaaacggcaaaaaaggtgattacatttttaataacagggttatcaatctaaaaaaagaccaagattttgaccttgctacaattgcatggcacgcaaagaaaaccaatattgccgaagataaactcaatcctgagactggaaaggttactaaagaatataactatggctggaactccattacaagttattttgtaaaggaaatactagatgatggtaacggaaacgaacctcacccagtagtccatgcgggtgataccgttattattgattgtgaacgtaacgagacctcattaattcatggtgggtcagttgattctctagaaaaaagagtttcattaggctcaacatacccctcactttggggcggtcaatcagaggtgattggctttaatgtagacccaaaagaggttgacattgagatgacttaccgaccaacttatttatagaaaggaggacttttagttgtatgtaattttagatagaaaccttgaaagagttggttcactttctaatgaaggtggcacccccttttggggtgacgaagtaagcgttcaaattgctgaccaagatgccgatatcacgccttcagatgtgcctgttagttacaacgttggcacaagtcaaactaaccaaaaaaattggaaccatactctaaattctattaacattccttatggttatccagacacagataaaatagttattggtagttctcttgcttaccaagacccgactaacaatcgttggtatgttatgagaataactgatattgatgatggatttacaccaagcggagttcattacaagagtgctattggtatcaacctatctatttgggacatgcttcatacaaaaaccaacgcatggaataatgatgattcgagttggcatgatggcactggagatgtttatttagagcaagttgtaggtgctcttttagagggaacaggatgggtaccaggtgagattaattattctggaaacacctcaggcattacgattagtggcatggataatgctcaatcacaattacaaaacatttgtaaggctttcaattgtgagattgacgcttatgtactttttaacagtgctggtcaaattgttgaaaaaagaatcgactttgttaatgaattgggtgttgacgaaggtcgtacagttcgttttggtgatgatttaattgatatgaagcgtaaaacaacggatgcaaatttaatcacccgtttgtatccttacaatgttaacggtacagggattgaatccgttaacggtgggaaaggatacgtagaagatgagaaagcaaacaacttatactcatctggcgttttaaatattgatggtgctaagttcctagaaggtacggtacaatcaagtactatcgctaatttgagttctttaaaaaattgggctaaaactcaagttctaccaaagtttaatcacccacgtattaattatgagattactttaagtaataattttacggctggattgggcgatacaattagaattttagacccgaaaatggtaccagaagcaggtgttaagagccgtgtaattcagcgaacaatctcacaggctgaccctaaccaaaataaagttatcgtaggtgagtttgtaaccttacaggttataactcctagtattattcaacaaatacagaatgatattaataacaatgttagagaattgattaatgatctacgtaatggtacaaagacggcatctgtacagttaattacaccaactggaaagagctggagcaaggaagatagcagtaaaacaatcattgctagagtgtttgtagacggtacaaacttaaccagctatttgagtaaagcagcttttgtttggactaaaactaacaccgtaactggtgttcatgacttagtttgggaagaaaagcataaagacgacggttatcaggtaactcttgatgatggcgacgtaggtaacattacctgcaccattgaaggtgaatacttaaaaaccgaagcagagttgtcaatcagtattgataactctctttttttcgacaaaaaaaaggtagatttaccaaaagatcactggggtggcgctataactggcgcttttcaataccaatggtatgacgaggttaatcaaatgttgattgcctcagttgcttatggagacggcacaaaaggacaaggaaatcgttctaatgcagacgatactaaatatcatcgttttaaattagatggaacctatgttgattctatggtcgtccaaggtggcggtcatggcagtagtttcggagcgcacttggtcgatggtgtaccagaaatatggacattatcgaccaatacggcaggtggcaatgcttccttggctagatttaaatgggtacctaatgcggttataaatcaaggcaacggattagaggttatcgctaaaatgcctttaatagatggtcattggtttagacggatttcctgtgatttcgaacaaggatgggtgttatcagttatggctagtggaccagtggaagtattgaaagttgatgatttgctcgcgggcaagtggaacgcagtttacagttttaaaattcaacaatttggatttaatcctgtggctagtacgaagcccaactttaacaccatgcaatctaacgatatccattttccttacatgttcattaattctggtgacgcaaacaagaaagacccacgaattcttagttgtattaatgtagtcactgaatcggaagtgtttcatcgtgaaaacttgattgaaacttttggcaacaaatgggtagataactattttgaacccgaaacaatcggttactaccacgataaagaaggcccgtatgtactacaaggtttttccatgttgacaacggaaaatgatgttaattacttacacagaacactttttaaaactcgtttaaatgtacgtgatgatagtggtgataaaaagaactatatcgacaaagatactagtggagaggaggaaagcgtagtatgagttcaattggacaaggcagtataagcattgacgatagcactcgtattggtgaaaatgcacaagataccgcaaacaaagtagcgggaaatgtaaatgacattaatagtgataacaagctgacccctactgaaaagctaaaattaaagcaggaatatgacaaagatttaaagctctatgcaattgacgtatcacagctacaatctgctggtataccaaccactgaattagattctgctttgagtaatttaactaattttgtaactccattgttcaaagaaatgaatagaacttcaactgtagacagaaacgctttggatagtgtatttacagcttttgttacggcagataaaaactcctctcaagtatttgttaatatggttcaacaagtagcagatgatgctaaaaaagctggaagtgatgcaaaggaagtcggcaagaaagcacaagaagctggtgaagaagctaaagcatcagctggtcaagcacaagtggatgccactcaagctaaagcagacgcagctactgctcaacaagctttaaataacattcatttaagtgttaagaacgcagacggttccacatctactttcaatatgaatggtaatactatcttgatggatactgctcaaactatcattaatggtaaggcaagcattttagatgcaagtattgacactgctaagattgccaatgctgcaattaatacggcacagattgcagatggtgcgattaataatgctaagattgcgaacgcaagcattgatgacgctaaaattaacagtcttaatggtaataaattagttgaaaatagtattgcggctagcaaaattaacgttgacgacttaattgctaacggaattaatactaagaccttaacgtcggttaacttgaacacaagtacgttgacaactcctaacctcgacctcggatttaatggaacatttaccgaagattttgattatacacaaaatgcttcaatgttcttaccaaagaagaataaaggaacattgacctttaaccatggtgttttgcaatcctctggtaatatgcaaacctacgttggaggtcaatggggtggcatgaatagtaattacaatttccaagctggaattgataactcccaatggacggaagttgcgcccggttatatcaaactagatttattcagacaagatgatgccaattttgtagaacgtacctatatagatccgacaggttattactacaaatcaggaaatggcatcgctagttatttaggtaatgttttacaaactccacaagttcaaacgcctagtttaattggtaagtatatcgggccaagtgctggacaattacgtctacaaattggtagtaatggtaaagacttcggtttacaagttggctcttatggtggaggtgaaggagtattaagtgacttcatatataacactacatcaagtggctcatcaaatgtccatattaccgaaaatggtcgtctagttcgaacaacttctgcttcaaagtataagtacaacattaaaaatccggatattgaaacaactctgggagacagattgctaaatgtacacttagcaacatggaacgataagcgtgctgtagattcgtacgcagagcaactaagcacaggagaagaaagagaaaaatcttcaattgacaaatattatggtctcattgctgaacaattaagagacgctggtttagatatgtttattaattatggtaaaaaccatgaaatagagggtattcaatacgatcgagcatgggttccacttttatctgtcattagaaggctaaataataaagttaatgagtacgaattaagaattagtaaattggagggaaaaatcaatgaatgattttcaaataactaacattacaattgcaaatagtaatgataatgaaactaaaggagatttacgtaaaattggttattctggaaccttttcagatagttcacacttagaaggattcatcatgatgagtgaagacaaatttttcaccacaaattatgcagatttaaaaaacattgtagcaactcaaattattaaaaacttaggaggaaacaaaaatgagtaagaaagttagggaagtaattgaagaaacgaaaccagctaacaattctaatgaagaaaaagttaccgagttaaataataagattgcacaactggaaagaactaatcgagttttatctcaattaagtaatgatcgtaatgagagaatctgccaattagaaattgaagttgcgacatataaaacaatcaatagtaaggctgtctaaaatagacagttttttttataaaaaattaggaggaataaacatggcattatcaactaatcaaagtatctcattaagtggtgtatcaacgattaatggtgtacaggtggcaacattctcaactgtagtatctaaaggactatcatatacatcggtatcaacacaaattacagaccaagacttatacgaaaagaataaggctgaagtacgcaaagatcggaatgattttcaaacggtagccgataacttatctgatagcctagaatcaggttctgttaaaagcactgaataaataatctaacgatttaaaagaaagaaggtataagattgcacatgttgttaggattgtcttggggagaatgggcatcgattacaactattattgtttttatggcaggcgtggttagcctgctttttaagtacatcgtttttggctcatttcaggacgacataaaagatttaaacagaaattttaaaacactcaatgataatctgagagaaataaggattagcattacggagttagataagcgattagacgagcacgatcggcggttagaccgccaccacgagcgaattaaggaattacatgacaaaataaggggaggcagttactaatgaaaaatttaaaaaacatcaattggcatgatgggaagttatgggcgggattgattagtttaggcattgtgttaattcaacaattaatggtagcttttggctacaattatccagtcaactggcaaaatattataggaatcattaacaccgtactgacaatattagggatgttaggggtaattagtgatgtcacggtagttagtaaccaaaaaggagaaccagatgacaaaactaaataaattaaaatgggttgttgcgattgcagcagccttttttgttggaacaacatttacttctaaagtaagtgcagcaactattaacaacgattacgctttgagttcaaaccaagggtcatcgttacgaacaagcaacaacgtaatcattgcacatgctacagcagtatatgctcctgctaaaaatgtagcaatttatgaaaatcgtgaatggtctaacactactgcttacgtccagtacgttgttggtgatggtggcaagatttaccgagttggtgccgaggggtaccaagcgtggggggctggttcatgggctaatgctaatgcaccagttcagattgaattagcacagacgtattctagttcagagtttaaacaagattacatcacttacgttaacttgttacgttctagcgcaattaagtatggaatcccgaccgatgttgatagttcagcatggcgtggtgttaagtcccatctctgggtaaccaatcacgtttggggcgaccacaccgacccttatggctatcttgcaagccacggtattactaaagctcaatttgcgcacgatgttaaatatggatttagttcatctggaaataacgtaaatccagctccaaaaccaaacaagcctaataaaccagtgaaaccagcaaaaaaggaagctgttcacgtaaactatgccttacaccaaaaaggtaaacaatggttaagcccagtcaaagattttaattctgggtcaaatggattcgcaggtgttcctaatagcaagcacgacatgctatatatcaaggttaaccatggttcactcatgtatcgcgttcacacaatcgaagatggatggttaccttttgtacacaagggcaacaagaatgatactgttaacggcgtagctggtattaaaggacacacgattgatggagtgcaaatgtactatacaactccaaaaggtgagacttaccagcaagcttactaccgttcacaaactacgcaacgtactggttatctaggaacatgtgccgataatggttcagttgctgggtacgataactttgctggaatgttaggtgaacctttggatagattgcagattcatattaacgacaatagtaaatattaattatcaagctttttaagctctctggtcataatgactggagggcttttttattgtctaaaaaacaaaaaccactcaatccttaactgggatgagtagtttttttattgtctattattagcatgagctactttaatttttttggggacattttggggacatacccttgtttttgtactaatttatacagcctcttaaaaataaaaaacggctatacaatagtgtttatcgtctattaaaaacattagaatctttaatgtataaatgataaaattaaaacaactgtattgttagattaaataaaaacataaaagagtaggagcataatcatcatggtaaaagagtttccagatgacacattaactttgcatacagatgcgtatcaaatcaatatgatccaaacctattggaataaaggaattcacaacaagacggcgatctttgaagtgtttttcagaaatatgccatttgataatgggtatgctgtttttgctggattagaccgcattattgattatatcagtaacttacatttttcagagagcgatattgaatatttaaaggatgtggctggttatccagacgattttttagcttaccttaaagattttcattttagaggtacaattcgttctgcagttgaaggtgacctagtttttaataacgaacctattttacaagtagaagggccacttgccgactgtcaattaattgaaacagcgttattgaatattgtcaattaccaaaccttaattgctacaaaagcggctcgcattaagtcggtagttggttcagacaagttacttgaatttggtactcggcgtgcgcaagaaatggatgctgccctttggggaactcgcgctgcttacattggtggcttcgatgctaccagtaatgtacgagccggtaagaaatttggaattccagtaagtgggacacacgcgcatgcattggttcaatattacatgaatgattatgatgctttcaaagcgtatgcgacaactcaccgtgattgtgtttttctagtagatacatttgatacattaaaaagtggggtacctaatgctattcgcgtagcaaaagaaatgggcgataagattaatttcttaggagttcgaattgacagtggtgacatggcctatttatcgaaacgtgttcgtgaacaattagatgaagcaggtttccctaatgctaaaatttttgcatcgaatgatttagatgaaaaaacaatccaaaacttgaagatgcagggagctaagattgaagtttggggcgttggtactaagttgattacggcatatgatcaaccagcgctaggtgcagtttataagatggtgtcaattgaacgtgacggtaaaatggtggataccatcaaattatcaaataatgctgagaaagtttctactccaggtaaaaaacaagtttggcgtatttcaagaaactcagatggaaaatcggaaggtgactacatcactctttgggatgaagatcctcgagtagaagagtctctatacatgttccatccgaactacacgtatattaataaaacggtcactgattttaaagctcgtccagttttacaaaccatttttgaagatggtaaattagtttatgatcgaccaagtttggctgagattaaagaatttgctcgtcgtagtttggattctctgtgggatgagtacaaacgggatttaaatccacaagattatccggtggatctttcacaagattgctacgacaataaagttgctattatcaagcgagtccgtgaatatgttgggaaactaaaattttaacaaactaggtgataaaattgcgagaattacaaaaagagattattgaaaatttaaaggttcaaccgacgattgacccaaaacaggaaattcgtcgtagtgtagattttatgaaaaattatctaaaaaaagttcctagtttacgttccttagtgctcggaatctcaggtggacaggattcaacccttgccggtgcgttagctgaaattgcggttcgtgaattacgggaagaaacgggtattcaagactaccggttcattgcagttcgcttgccctatggtgtgcaagcggatgaatccgatgcaatgaaagcaatcgaatttatgcaagccgatgaagtagttcgaattgatatcaaaccagcggcagatgccatggttgctgcgttggaagctaatgatttaaaaatttctgattttaacaaagggaatatcaaagctcgtgaacggatgattgctcaatatggtattgcgggaagtaatgctggaattgtaattggaaccgatcatgctgcagaatctgttacgggattttatactaaatttggtgatggcggagctgatattatccctctttggcgcttggataagcgacaaggaaaggcaatgctaaaagagctcaacgcaccggttgaactttatgaaaagaccccaacggctgatttagaagaggagcgtccagcgttgcctgacgaagtggccttaggggttacttacgacgatattgacaactatctggaaggtcgcgaaattagttctgaagcggctgacaaaattgaaggttggtataaacggacggctcataaacgagttttaccttatacggttttcgacaactaattattaagagaaggggtttagcttgtaattagtttgaatggtcggttataattaaattgtagacatgagggagtaacttgcagactatctgcgataatatcaccaacaagaataaatctggtattatcttaatttagtgagactcatgtgtgtgggaaaagattccttgcgcacatgggtcttttttcatacccagcattaaaaaatagctaggaggaaagggaattatgcacaaagagcaatggcagttaacggtagaagaggttttgaagcaggaacaaagtaataaagagcgtggtttatctgctagtgaggttcaaaaaagaactgaacaatacggaaaaaatgttttagcaaccaaaaagaaaaccactcttttacagaagtttattgaacagtttaaagatttgatgattatcgtattgatgattgcagccctgatctccgtctttgttggcgaaggagtggatgcaatgatcatcatgctagtagttattttaaatgcggtttttggagtattccaagaagccaaggctgaggaggcgattgacgcgctaaaaagtttagctgctcctcaagcgcatgttcgccgagatggaagagtacaaacgataaaaagtgaggatttagtcccgggcgatatcgttctgctcgaagctggtgatatcgttccagcagatttaagattaattgaatctgcttcaattaagatggaagaagctgcactaacgggtgaatctgtaccagtaaataaagcagttgctcccattgagggagaaaatccggcactaggtgatcgtaaaaacatggcatttatgaatagtaatgtaacgtttggccgtggactaggtgtggttactggaacgggaatgcaaactgaagttgggcgaattgccgacttaattaataatgccgaagaaactattaccccgttgcaacggaacctgattaagttgagtaaaactttaacttggctaattttaggtattgcggtggtagtattcatagtagggatgttacgtggacaagaaaccttaattgatatgttattaacagcaatttctttagctgtagcggctatcccagaaggattaccagctattgttacgattactctagcattgggaacgcagcggatggctaaaagacatgctattattcgaaaattaccagcagtcgaaactttgggaagtactgaaattattgcttcagataagacagggacattgacccaaaataaaatgactgtggaaaaagtatttgtggataaccaactcctgaatgccgaagaggttattccagatactaaacaaaagctatacgatttaatgattttaaataatgatactaaaaaaattgagggagaattgatcggtgatcctacggaaaccgccttgattgcattcaatgattccaaaaattatcaagcggacgaagttattaaaagttatccacgggtggctgaggttccatttgactccgaaagaaaattgatgtctactattaatgctttggaagatggaagatatcttttaacagtgaagggtgctccagatgagttgttgaaacgaactactcaatatgtggaaaagaaccaaattctcccaatgaatgatgctgaaatcaaactaattcgggcgacaaatcatgaactagctacacaagctattcgagtattaggatttgcttaccagattttagacgaaattcctacagccttagatagtgaaactgtggaaaaagatttaatttttgctggtttaattggaatgattgatccagaacggaccgaagttgcacaagctgtcaaagaagcccaacaagcaggaatccggaccttaatgattactggtgatcatcgtgatacagcgggagcgattgccaaacgtttaggaatgattgatgaagatgaagttgatacagccgtaatcacaggagccgaacttgatcaacaaacggatgaagaattggctcgaaatgtagataaatatgctgtatacgcacgagtggcaccagaacataaagttagaattgtaaatgcttggcaaaaaaagggaaagattgtcgccatgactggtgatggagttaatgatgccccatccttgaaacaggcagatattggagtggcaatgggaatcactggtactgaagtttccaaaggggccagtgatatggtccttgcagatgataactttgccaccatcgtagttgctgtagaggaaggacgaaaagtttttgctaatatccaaaaggcaattcagtatcttttgtcggctaatttaggtgaagtattaactttgttcgtaatgaccatgatgggatggcaaattttagcgccggttcatattttgtggattaatctagtcaccgatacgttccctgctattgcgttaggacttgaaccagctgaaaaagacgcgatgaaacaaaaaccgcgtggtaaaaatgcaagtttcctatcaggaggcgtggctagtaatgtaatttaccaaggaattttagaaggggttattactttatttgtttatgcgatggcactccgttttccagatcatgctacggctactcaaattcacgcagatgcgttaacaatggcctttgcaacattaggcttaatccaactatttcatgcgtttaactcaaaatcagttcatggttctatttttagtgcaacaacgctaaaaaataagttcttcaactggtcaattgtaatttcgtttgtgctattagccgcaacaattgtggtgccaggattaaatgatttattccatgttagcaacctaaatctccaccaatggatgattgtaatttttgcatcattatcgatgattgtgattgtcgaagtggtaaaattaatacaacgtactttaaaaaaatagtggagagattaaatgagagctaatattcaaacttatgctggtacaatttccaaattaactgaaatacttgaacaaacaggagaccaggtcgatccatactttcaagaactaaaaaaatggatgcagttgggacaagttgctgatctagatcaagctaaattagcagaaattaagaatcaatttcagctggctacagataactaccgttcaattgaaaaagaacttacagaaatgcaagctcctatcaaatttatcgggaaacaccaaaatttgaaacatgattatcttcgatatgttgaagaatgtcaaaaaatggtggatacgattaatccagaagctaaaaaagttaatgctgaagattttaatgcttctgaaaaggctcaagcagaaattatgggccaaattaccaagacgttaactagaattatgaatatgttgcttgcataatgtttaatatagcaatacgagaatacgagaggttgagggagaagttggttcctcagcctcttcttgttagattattaagataatgggagaaaaagattttggaagaaaaaattttaaaaattgtcggaactaagttaaaagattatcgagcaaatcaaattaaagctacactagaaatgctagaggatggaaatacagttccctttatcgctcggtatcgaaaagaacgaactcaaagtttagatgaagttcaaattcgggaaattcaagcaacgtaccatcagactgaaacacttgaaaaaagaaaagccgatgttttaaaaaatattgaagatcaacaaaaattaactccagaattggcgcaaaagattcgtacagccgatgccttacaaacggtagaggacttgtatttaccatacaaacaaaaacggcggacgaaagcgacaattgctaaggaagcaggtttagaaccgattgcaacctggattttgggttttccacaaggaactttagctaagcaacttcaaagtgcgattaatccagaacaggatcttaatagtgttgacgatgttttagcaggagttcacgaaatattagccgaagccttctcggaccaagctgatatccgtgaatgggtgcgaagttataccaaaaaaaatggacgattaacggcagaagtaaagcccaagggccaagcaattgatgagaacggtgtttatgggatttactatgacttcagtgaaaaactgaatcaagtggcctcccaccaaattttagcgattaaccgaggcgaaaaagaaaaggtcctacgagctaaaattgaggttgatcctcaaggaatcgaacgataccttcactttcgtttgattggtaaaaagaccggcgaagcagttggtatagtcgaagatgcatatcaagatgcttataaacgttttattggcccagcaattgaacgtgaattacgtgcagaactgactgctatgggcgaccaacaggctattaaggtgtttggtgaaaacttataccatctcttgatgcaagcccctctaaagggaaaagtagtcttaggttttgacccagcttatcggaccggttgtaagttggcggttattgatgagaacggtaaatttttagataaattagtgatttatccacataaaccagcttcaatggaaaaacgagctaaagccggaaaacaattaaaagatttcattgagaagtaccaagttgaaatgattgcaattggaaacggaacagcaagtcgcgaatcagaagaatttgtagctaatttaattaaagaaattaagcgtcccatctattatgtaattgtcaatgaagcaggagcgtcagtttattctgctagtaacgaagcccgagaggcatttccagatcttcaagttgaagaaagaagtgcgattagtattggacgacgcttacaagatcctttagcagaattgattaagatcgatcctcaagcagttggagtcggtcaatatcaacatgatgttgcgcaaaaagatttacatgaacaacttgataacgtcgttgaaacggccgttaaccaagttggggttaatttaaatactgctagcccagagttgctaacccatatttcggggttaactaaaacaaccgctaaaaatattgttaattttcgagaggaaaatggaagctatcattctcgcaaacaattaaaaaaagtccctcgcttaggacctaaagcctatgaacaagcaattggttttttgagaattgttgatggagatgatattttggataataccggaatccatcctgaaagttatgcagttgttaaacaattagtgcagttattgggactaaaattgcaagacattggtaaagcggaagttaacgaaaaactacagggagtgcaggttaaagcagtcgctgaacagcttaacgttggctgggaaactttagctgatattattgccgaattacagaaaccgggacgtgatttgcgagatgaaatgccggcgccattacttcgatcagatgttctaacgctagaggaccttaaaccagggatggaacttcaaggaacagtaagaaatgtaattgatttcggagcatttgtagatattggggttaaacaggacggtttagtccacatctcaaaactaaagaaaggttttgtgaagcaacccagcgatgtggttgcggtcggggatattgttaaagtttgggttgaaagtgtagacgttgaacgccaccgaattcaattaacaatgattcctaaggattaaaatgacagatttagaattgcaacaattaactcaacgcattgctcaagagtcctttggtaaaagttttccgtataaggtggtctttaatcgacgtttaaaaaccactggtggtcgctatcatctaaatgatcatcatattgatattaatccgttgatgctggaagaattcgatgaagcgaccttgatcggagttattaaacatgaactagtgcattattttgtgcatatgttaaacgagaaaccagatcatcgaaacccacattttcagcagttgttacgagcggtgggaggattaaggtatgctccaaccacctctaagcgtcggcgaactcctcccaagttactatatcaatgccaaggttgtggattacaatacccccgacaaaggcggattaatacacgcaagtatgtgtgtagcaagtgtcgcggacgactcaaattattataaattagattttttaaaataaaacgtaaaaaaagtcttgctagcagtaggtagatttgatactattatctagtaagcttttgcggccatggcggaactggcagacgcgcaggattaaggatcctgtccgaatttactcgggtggaggttcgaaccctcttggccgcatcaataaaaaaggactcctagaaataggagtcctttttgtgtttctaagaactgtttcaatattgacacactttttaatacacaattaatgtattagtatcgatgtgtattaataagaatgctgattctacggtatttaatcattagtgtattttggcacggtatttgcttatatataggtgaatgcaaaatatgttgaattatcaatgtgtttcgcacatcgaagcgggtttaaccactttgatggatggatgtttatctgatgagaagccattttaaattaaaacttaaactttgaaaaacacgatgggattaatcagtcccatcttttatcctagataattgaaagcgttttttgaaaattttaatttaagttggtttccaaacgaataaacgttcaatttagatttaagttacaggttttagaacttattttatttattttttgattaagctgtaacaatataatatgggaggtatacagacagatggttggaattatcattgctagtcacggcgaatttgctaaaggtattttgcaatcaggttcaatgatcttcggtgaacaagaagacgttaaagctgttacattaatgccaagtgaaggccctgacgatatcagagcaaaacttcaagaagcagttgcttcttttagtaaccaagacgaagtattattcttagtcgacctatggggaggcactccatttaatcaagttaataacttgtttgaagaacacaaggacaaatgggcaatcgttgccggtttgaacttgccaatgctaatcgaagcttatgcttcacgtttatcaatggaatcagcacaagaaattgctgctcatatcattgaaactgctaaagaaggggttagggttcgtcctgaagctcttcaaccagaagaagctccaaaggcagcagaaagcgcacaagttgcttctggtcgtccaggacacttcgattatgtattagctcgtatcgatactcgtttacttcatggacaagttgctacagcttggacaaagacgactaaaccagatcgaatcatcgttgtttctgataacgttgctaaagatgaacttcgttcttcaatgatcaagcaagctgctccatcaggagttaaggctcatatcgttcctattgatcaaatgattaaacttgctaaggatgatcaacattttggtggaacccgtgccatgctattatttgaaacaccacaagatgctttgagagcaatcgaaggtggagttccacttaagtcattaaacgttggttcaatggcacattcacctggtaaagttcaacctaataaggtattggcttttgaccaaaatgatattgatacttacaagaagttggaagacatgaacgttgaacttgatgttcgtaaagttccaactgattcaaaagacaatatggatgcaattatgaagaaagctcaagatgagcttaacgcaaaaaaataatttaattataacggaggattaataatcatggcattgaatgcaattcaaatgattttagtcgttatcgtagcgtttttagctggtgtggaaggtatcttggatcaattccatttccatcaaccagtaatcgcatgtactttaatcggcttagtaactggtaacttagtaccttgccttatcttaggtggttcacttcaaatgatcgctcttggttgggctaacgttggggctgctgtagctcctgatgctgctttggcttctgtagcttctgctattattttagttttaggtggccaaggtaaagctggtgtttcatcagctatcgctcttgctgttcctttagctgtagctggactattattaacaatcattgctcgtacacttgcaactcttatcgttcacgttatggatgctgctgctaaagaaggtagcttcggtaaacttgaagcatggcactatgttgctatctgtatgcaaggtttacgtatcgctatcccagctggattgattcttgcaatcggtgctggtcccgtacgtagtttacttgctgctatgcctgcttggttgacagacggtctatcagttggtggtggtatggttgttgccgttggttatgcaatggttatcaacatgatggctactaaagaagtttggcctttcttcgcgcttggtttcgttttagcaactatccctgatttgacacttatcgctttaggtacaatcggtattgctttggctcttatctacttaaccctttcaaaaatgggtggttcaagtaacggaggcaactcaggttccggtgatccgctcggcgatataattgataaatactaaaaggaggccaacagaaaatgcaagaaaaagttcaattaactaaaaaagatcgtattcatgtttggttacgttcaacattccttcaaggttcatggaactacgaacgtatgcaaaatggtggttgggcatatacattaatcccagctcttaaaaagttatacaaaacaaaagaagaccgtgccgcagctttgacacgtcacatggaattctttaatactcacccatacttagctgcacctatccttggtgtaacaatgtctcttgaagaagaacgtgctaatggtgctcctattgatgacgttgcgattcaaggggttaaagttggtatgatgggacctcttgccggtgttggtgatccggtattctggtttacagttaagccaattattggtgctttagctgcttcacttgctttgggtggtaacatccttggaccaattctttacttcgtactttggaatgctattcgtatgggattcacatggtatacacaagaatttggttataaagctggttcaaagattacagaagacatgtctggtggtttactacaagacgttactaaaggtgcttcaatcttgggtatgtttatccttggttcattgattaaccgttgggttactgttaagttcacaccagttgtttcaactgttaaacaaagtaaaggtgcttacatcgactgggcaaaccttccaagtggtgctaaaggaattcaagaagcattgcaacaacaagctgctggtctttcattaactccagaaaaagttacaacattgcaagataacttggatcaattaattccaggacttgctggattacttctaacacttctttgcatgtggttacttaagaagggtgtttctcctatcgttgttatctttggtttattcatcgtcggtgttgtacttcacgtactccacgttatgtaataaacttaaattaagtctgggctatggcctaggctttttttattaaaatttttggtgaaatgtaccttaagtattataattggataaaaagaagaatggagtaatttgaatggctcaatcaattaatacaaaagcagatttggtaatcgatgctacctcatttttggggatgggtgattacggaaaaattatgattggcgatcacggttttgaattttttgacaatcgtaatgttgaaaacttcattcaaattccttgggaagaagttgatacagtgattgcttccttggtctttgggggtagatggattccaagatttgccgttaaaactaaacgaagtggaacctatagtttcgcttctaaaaaaacccatgaagttttaagagaaattagaaaacatgttgatgctgaccgcatggtacgttcgttaggggtttgggacgtaatcaaacgaggagtaatgagcattttcaagcgtaaagctaaataataattaaataatcttttgaaactatgctaaaaagcgatttgaaacggcctgattaaagcaagtctaaaaaatatttggacgagggacggaaagatgagttttttagcatagttttttgtttgaaagcgtttgttttaaaactgtgttaaactgtattgtatcaattagtgtattaatacagattgcggtgagaaaatgaaaagacaagatagaatttatgaatatgttattgaaaatacgcaaaatgtttccgatacggaattaaaggagcaagctgcattaacgacgagtttaatcgcagagaacttgaacattgctcgaagcaatgttagcaaggaactaaatgaattagttcgtaagaataagttatccaagattagtggacggcctgtacgttattgtcgacctttgacagaagaaggacaacttccccaacaatccagtcaagatccatctagctatcacattgaagatggtattagtggaatggacctggggaagaagaaattagcaggtacccttgaagaaccaactcgaccggttactttaaataaaaatactaatatttttgatcgaatgattggcaagagtcgaagcatgcataaccaaattgaacaagccaaggcagccatgttgtatccaccaagaggactgaacacattaattattggcccgactggttctggtaaaacatactttgccaatgcgatgtttgaatttgcccaaactaagggtttaattgatcgacagcaacagttggtaacctttaattgtgctgattatgcacacaatccggaattattgatgtcccatctatttggttacattcaaggtgcatttacaggggcaaatgatgagcaagatggtttgattcaagaggccgatggtgggatgctcttcttggatgaagttcatcgacttccaccagaaggtcaagaaatgattttctatttcatggatcatggtacttataatcggttgggggaaacttccaagaaccatcatgccgatgttcgtttagtctgtgctacaacggaagatccagaaagttcattgctacagacttttgttcgtcgaattccaattaccattcaacttccggcatttaataaacgtagtccggaagaacgaattgacctactacgttcattggtaacaattgaagccaaccgaactaataaagaaattacattaaccgaagatgttgtccaggctttattaggtagtgttacgtatggaaatgtgggccaattaaaatctaatattcaattagtatgcgctaaggggtttttgaacaatatcgaaaatgaaggcgaaatcatgattacagcggatgatttgccgtcaaatattaaggatggattactaaatttagcctctgaccgggctgaacttggggcaatttcgaagttactagaaccctacatggtaattaaaccgggatcatcttatgcaactcccgttagccgtaaagatagctatgaactgccctataatttgtatgaaatcattggcgataaagcgatgatgttacgtgaagagggtcttgaccaagaaaatatcaataattttattactacggatattaacctacatttaaaatctttctataagaatgaatcagacactcgtcaagcagaaagtaaactagctgaaattgtggataaagggattattgattttgctaaacaggttcagcctaagattgaaaatcaattagattatcattttaaagagaactttatatatgcaatgagtttgcatattagttcatttattaaacgaattcaatctggaaaaccgatgcggttgatgggcaatgatttagttgcaatggttaaggattatccagaagagttggcggttgctaaatcgattaaggaaatgctagaacagcggtatggaatgccaattcctgaatcagagagttactatttagcagtccttttaatttcactaagaacggtcccaactagtaatggtcaagtcggtattgtggtggcagctcatggaagtagtacagctagttctatgacacaagtcgtctctcaattattatctgacaactcgattcaagcttttgatatgccgctcgacatgaatccgcaaacggcgtataaggggattgtggagcgagtccgagctgctaaccagggggaaggagtacttctactagttgatatgggatccctaagtacctttggatctaaaatcacggaagaaactcaaattccggttaaagttattgatatggtaacgacggcgatggtcttggaagcgaccagaaaagcttcttttatcgatagtgatttgaacgatatttatgctgaactacgtgaatttcacggatactccagagttgcaattgcggatgaaagtaacgttgaagaaagagcagaagatctatccatgatttctgggaaacccaaagcgatcgttgcggtatgctccacaggtgaaggaaccgccaaaaaaattaaagatttactagatcaactcttagttcaaaatttaattgaggatatcaaagtttttccgatctccatagtaaacatgcaagatcatatccaacaaattaacaccaaatatacgattgtcgcagcgactggagtaatgaatccacaaattggagtaccatttatgcctcttcaaacacttttacagggtggaggagaaaagttcgttcgacagttggcagaacgtagcgaagtatcatgggtgcttgatgaacaagactctaaattgacgcgtagcgtttgtcgtcaatatttatcacagtactttgttttcttgaatgcggataagttcacggatattttatggaattatgtggattacttggcagaaactaagaaagtggaatttagtgaatccttccgcatcaatttaattatgcatattgcgggagcagtggaaagaatgcttaccaataatccgatggaaacagcaccggaagaattggctgcggttcaggatgaagtgtggtttaaattgatacaaaaagcggatgataagtatttgagaaggattcaaattgaaatgactccaagtgaagaattttatatttataaattgttggaaacatggcaagaaaaaaatgatacaatcctaagtgaggtagattaaaactaatcttaattttggaggacacggtgatatgacgatggacattctactggctcgtgtcgatagtcggctcttgcatgggcaagtagcgactgcttgggctaaaaaggttaaacctaatcggattttagtcgtttcagatagcgttgcagaagataatttacgtaaaacgttgattactcaagctgcgcctcctggaatattagtaaacgtgattacggttgaaaaaatgattcgaatttatcaagattcgcaatttgattcttttaaagtgttacttttaacggaaaccctacaagatatgttgaagctggttgatggcggtatcgatgtctctgatttagggattgatgtgggcagtttggcatacgccgtagatatgacaatgctaacagatgcgattgcggttggtaaagaagagattgctacaatccgaaccctacacgaacgtggattaacagtgtatgctcagaaaattcctaatgatagccgtaaagatttgataaaaatgttagataaaaataatttataataaaaaataacccacaactttaatagttacgggttatttttatggtccaaataaatgttaaagttcctcaagcacctgattttctttaatctttggttcgggttgtttttgacgattttgaatttctcgttctattttaaacaaaacttctttttgagaagcaggaacgtcaatgttaaaacgaccagtggcagtttcgattgttaaacgagccttgaatccggcaatacctagaattaaaccgataatgatggctaaaattccgattgttaagcctttattcatggcacttaaagctcctaaaacaattaaaattaaaccaagtagtagcgggaaaaactgatttttacctttgatgctggtagatttaatatcacttagtgcaatgtctttagaaattagaccataagggaaaacccatagtaatagacgagggatgcgactacgaacagattggttgtccacttcgacgcgacctttcatccaaaaaataagccagctaattgaaaaattaaacattaatattcctccagtattgttccattgtcttattaattaagcataattatttaacgattaaaaggcaagttttctacatgagatccattagatttcttaatataattataagaacttaattaatccgattgttacaacaatgaaaacgtttgttagatgtgatctgtcacgcacactattttcacaaataatattttactggtagaatagaatgataaacaaagtgaggaagaagcttaaaatgagtttaaaaattttatctacagcacattatgtacccgaacgggtggttgataacgatgagttatccaaaattatggatacaaatgatgagtggattcaatcccacacaggaattcaaactcgtcattatgccatgggcgaagagaatacatcaagcttagcagtcgaagcgggacaaaaattattaaacgaaagtggtttaacggctgatcaaatcgatgttattattctttcaacgattacgccagacgctttaactccggctactgcaaccattgtgcaagctaagttaggcgccaaaaatgctattgcttttgatatatcggctgcttgtgctggatttgtttttggtttaagtacggctgaaaaatttatgcgttctggacgttaccgaaacgcgatggtgattagtgcggaaaccaattctaaaatgatggattttaaagatcggacctccgcagtattttttggtgacggagcgggtggtgtaattatttctgctgatgcgcataacacagaagatttctttattgacgaagaattagccaccttagcggaaaaaaatgagtatattcatagcggccgaattccggctttaacggctgtgaaagctaataactttccaacaatcgacgcttttttccaaagtggacgagatgtttttagttttgctaccggagtagttcctcctcaaatggtagaaattttaaatcgaaatgatttacatgataaggttgattacgtaatctgtcatcaagctaacttaagaattattgaaaagatttctgaaacgattaacattccaatggaaaaatttgttacgaatgttgaacaatatggaaatacttcatcagctggaattccaatggcattggctcaactccaagaaaaagatcctaatcctaaaactgttttaatgactgggtttggtgcgggtctggactatggaagtatgttgattagaatttaatcattggaattaaaactaaactgtggttcgtaatgtggaccacagttttttagtatcttcatgtaaaaatttttaatgggattaagacttgcaactagttagaaaatgaataacaatgaagtagagttgaacgataagattgaattaatattgagcagggagagaaaagaattggctaaattagttttaattaggcatggggaaagtaccgccaatcgtgataatatttatacagggtggtcggatgttccgcttactccgcttggtattaagcaagcacaacgagcaggaaaattaattgctaaattaggaattaattttgatatggttcacacttcaatgctgaagcgcgcgattgtgactgctaatatcgttttagatgatcttaatcaaaattggttaccgattaataagacttggcgattaaatgaacgccattatggggctttaaggggacaaaataaggatgagacccgccaaatttatggtaaggagcaggttgctttatggcgtcggagttttgatgcagtaccacccctgctagagcatcccgatgatgatcgacgatatgcggttaatggaattttgaatgaaccactgggtgaaagtttacatatggcttataatcgcttgctaccatactggattgatcaaattgctcctagattaatggaaggacaaaatcaattggtagtcgcacatggaagttctttgcgagcattaattaaatatttggagaacatttctgaccagggtattgatggagtcgaagttgaaaatggagaacccatcatttacgaattaaaatcggatttatctatccaaaataaaattatcttgaaagaagcctaattatttaggctctttttttatgcataaagtattgatttcagtaaaatgggacaattttgtctctatgcgacaaaatagtgcgtacttctataaatgtcataattcacttatattatctatatcgtttgagagagaaaatatgaggtgagataatgattaatcaaaaatctaaagctaattttgctttatttgctttggcagtaatattttttgcggttggtatcacagaatttattagcgtgggggtactaccagcaatttcaaaaagttttatgattacgacttcgacagccggactaataactactatttatgctttaggagtagcattaggtgctccaattttaacaattttaactgctaaatttcagcggaaaggaactattttaggggctgttattatttttataatcggtcacttaattattggatttgctaccaattttggagaagtcatttttggcaggttaatagctggtgcttcacatgggttattgtttgcgctcagttcgacaatagccgccgaattagttgatgaatccagacaagcgagtgcaattgcttatatttttacgggtttcacaattgcgacagcactgggtgctccattggggacggcggttagtacttattggggatggcggataccttttttggcgattgcgactttaggaatagtagcatggattttaaatcgagtagctttacctaaacaagctagaaagaatgtagaaatatccagcatagcagatcaagtaaagttgattttgcatccacatgttttattaacgctcctaattaccatcttaggatatggtggtacttttgcaaccttcacgtatttatcatcaattttgcaaaagataacccatgtccctgcgaatcaagttagtttattcttagtgatttatggtatagctatcgcaattgaaaatacgcttggtggtaaactaggaaatgctaaaccgattaacgctttattcgggatcttcatcgttcaagggttagctttatttgctttttattttacagttactaatatatatttaagtactttaaatatcgtgctcttaggtttagttgcttttatgagcgttccggttctacagtcgtatattttaattttagctaaaagttattcatctaaagcagttgatgttgcctcatccttgaatatttctgcttttagttttggcattgtaggtgggtctttcttaggaggagttgcacttgatacttatggcttaagaagaacgatgctactagcagcagctatggttgcattagcagttttattgatgttggtagaaaataaatttgaaaataaacgtcagaaatagttttagaaaatgctgtcgttccaaaaggacgtgctaaaattacccagtaggaggtttggttagatgcctgaaaaaatatatcatgtagcagttgaagcaactttagatgtaataggaggaaaatggaaacccgtcattctatgtcatctaggaggtcgtactctaagaacgggagagttatgtcagttaatgccggacgtttcacaaagagtattgactaggcaattgcgcgaactagaagccgacaatattgttcaacgtaaggtgtacaaccaggtaccgccaaaggttgaatattctttaaccgaagagggaaaaagtctaagaaatattttattagtaatgtcaaattggggtaaggataaggttgaacgtctgcaaaaacaaggtaatagtgtagaaattattgataacgatccgcatcccttttcaaatatggagtagtaaaaaagcgactagttaaggaccgattttcatttggtccacagctagtcgcttttttattgataaaattatttattaatcttgataagccaaagatcccattgggtcccaaggtttcaaaacggtaggtgtttgagactgcgcttgacgttgcgcttcggttaagaattgtttttgaacaactacttggtaacaatattcgtccatccaggcatcggacattaccatatagcctttttcaccgacttttttaccccaactattttcaactttccatttagttggttgaccatcgacaagatcgacgccagtaagtaccatagcgtgagtcattaaactctctttgtagtctaaacgttcagctttagacattgaaagatcgatatcaaacaactcatcttcagcaaaaacatctaggtccaaaagtcccttttcacgagcctcagagtgttgaccaacatcgcaaccaaaccacactgattgtccagctttaagttggttgatggccgcctgcttgaagtcgtccatagcaaggtttagatgtttaacttggcgtccatttacgacattgccaagcatatcaattgtatatgtttggttgtaaggtttgtcagcagttggcgcattaatgatggaaatatattcggaaaggttccaacctacatacttatcataaaatgctttaggcgtaatacctgcttcacgatgataattttgatcggcgtcacgatattcccaatcgaattgaacaggtggttctccgaaactgtaagaagccatgcgatagacttcactaagcatttgttgcttacgttcatcaatgtctgtacgacttgcccctgaattaactaaattacgtaatgtaactgcatctttgcgtaacttttcatttagcaatgtgtcgaattcacgagattttgaactattataagtttcagggtaggccgattgaggaactacaccgtatttttcaatcaatgcgcaaagcatatcccattggccaccatcaccttgaggttcatttaataagaaggccactttacggtcatcagtatcaagctcggccgtattaatgatattttcgtagaaccaatttgatttttcaaacttatcccagaaaaaagtataattttgggataattcaaaattgccaggaactttgaattggtttttcatgtcatgacgcatagtattcaaagcggcaaacatccaacaacgaccactttgtttctgattcgcaacatcaccggtatctaaatcaattgaaaaaacgggtgtgctttgaacatcagctgcaaggttacgactggaattaagaattccatttttagtaactgtgcgttcaataactttagcttctttacgaccgttatattcttgtttaaaaaggtcaattaaattttgtgaaatttctttactcaatatcttcaactccatcctaatattggtgatgattatacgctaattaaaaaaattagtaaatgattagaattatggtcgagcagtcaaaacttctggaccattttggcgtccaacaatgacagtattaaccatgtcaaggaacaatccttgttctacaataccaacttgtttgattagataatctgctaattgatgcggatgtttaatttcaccaagatgaagatcaattacgtagtttttagaatcggttaaaacatattcgccagcatcatttttcctaaattcaggatgaaggccttctttttcaagcttcttgaagacttgtttgctaccatatggaattacttctagagggagtgggaaggcccctaagtgatcaaccattttagattcatctacaatccacattactttttttgagtttgtggcaacaattttttcaaacaagtgagcggcaccgccacctttgataccttggaagtcagaactgatttcatcagctccatcaatggttaaatcaatatgatcaacctcgtcaacagatttaacattaatgcccaatgaacgggcttgttcagctgtacgattggaagttgggaccccaacgatatttaaattttcatttttaacgcgttcaccaagagcgtccaccataaatttaacagtagaaccggtacctaaacccacagtcatcccatcttcaataaatttaacggcttcttcgccaactagtttttttaattcgttttgatccatttcttaatcttcctttcgacttactaagctttgtattttagttgctgtaatttggtcgtgcatgttccattcggaaagttccggatggttgagaaaatattttcttgcaaagggacaaagaggataaattttctggttattttcaattgcaaaattaatgaagtttttcatcaatttgccaccccagccttgtcctcgaacttcaggattaacaaagacttcttcacagattaaagtatcaagatcgggaattttagaatagagcacatgtcctacttgcacaccttcggaattagtccaaaaaagacggtttgcttcgatatttctttccatacataagcctccttttcctacaataatcattgtcgccaagaaagcgcataaagtcaattgcttcaacagatttccgtttacaaagtgggtcaataaaaggataataaaataaatgattattaggagggaaaccgtaatgagtagaggatttgaaattattagtaagtatcaaaatcaaggattacatttaccccaacgacaaacaaaagcagccgctggatatgactttgaagcggcagaagattttgtgttgccgagtatttggaaattgaattttgtgaaggttttgtgggccctacgtcatcaagaaaatgtaacagacgaagtattagatgcggctcgagcagaattaaaaccatatttagtaccaacggggattaaagcatatatggaagatgatgagtatttaatgttggccaatcgttctagtaaccccctaaaacgtagtttaattttacctaatggggtaggaattgtggacgcggactactacaataatgaaagcaatgaaggggctatttttctccaacttgtaaattatggaattacagatgtaaaaatcaaaaagggcgaacgaattggtcagggaatttttatgaaatatttagtagctgacaacgaaacggcctcagaacaaaagcgaactggtgggtttggttcgactaagtagtcattaaaaatcaataaaggtcaaactaattttgattaaattatagaaataaatgctatcctaattgtacgaatttaaagttgaggggggatttaaagcttggctaaagtaaaaacacagtttttgtgttcagaatgtgggtatgtttcacctaaattcttaggacgttgtcctaattgtggaagatggaacactctggttgaagagcggattagtgaacctaaaaatgaacgtaagagtcgcgttagttttgagggtaaaagtagtaaaccacaattaatttcagaagttaaaatgcacgaagaaccgcgagttaaaacagggatggaagaactgaaccgagtactcggtggtggagtagtagatggctcactagttctaattggtggagatccaggaattggtaagtcgaccctattattacaactatctgggcaattagctgctactgatcgagatgttttatacgtgtctggggaagaaagtgcttcacagatcaagatgcgcgccgaacgtttacaggttaacagtgaacgtttttacttataccctgaaacagatatgtccaatattcgtgcggtcattgaggaactacatcctcagtatgtaattattgattctgttcaaaccatgcaagagcccgacattgattcagcagtaggtagtgtatcgcaaattcgagaaattacagccgaattaatgcagattgctaaaacaaataacattactatttttattgttggtcatgtaactaaaggcggagccattgctggtcctaaaattttagaacatatggttgatacagtactttattttgaaggcgatttgcatcatacgtatcgaattttacgagcggttaaaaatcgatttggttctacgaatgaattggggattttcgaaatgcgagaggaagggcttcgagaagtagccaatccttcggaaatctttttagaggaacgcctgcaagatgctaacggttctgctattgtggtttcgatggaaggtactcgaccaattttggtcgaaattcaagctttgattacgcctaccatttttgggaatgctcagcggactgctagcgggttggatcgtaaccgagtctcattaattatggcagttttagaaaaaagggctaatttaacgttgcagaaccaagacgcctacttaaaggctgctggcggagtgaaattggatgagccagcaattgatttggcaattgcgatgagtattgtatcgagttttaagaatcaagggacgagaccgactgatagctttgttggcgaaattggtttaactggtgaaatccgacgggttaatcgaattgaacaacgggttgccgaagctcaaaaactaggttttcaacgaattttaattcctaagaataatttaaagggttggaatcctcctaaagggattgaagtagtaggagtaacaacgattacggacgcaattcgaaaggcgtttaattagaaaggaggtgaattaaaatgaaaaatattaaaaaacgaattgtccaagcggtgtttgctttggctggtggtactttaggaatgtcgtatctaccagttgtttggtcattatcaaatttggataagtttattttattaaacaatcgcgtaacgggctttgttattggtgcaattattttctgggttctatctatctttttggctggttatgtattgagtttaatgagacgagcagaaaaaatgttaactaaatcttcgccaatctatttaattactagtggtgttggaacggtcattggattggtcattgctattttaatttccactttattttatcgatcagatgtcttctttattaatacgatgattccattaattttaatgttgattttgggttatttaggttttcgaattggaacaactcggctaaacgagtggaaaaaattattccaagttcgcaaacgtgatttaaataatcaagatcaagtattggagcgtcgagcaggtgaaaattaccatcactacaagattttagatactaatatcttgattgatgggcgagtatacgatttagtaaaaactggattgttagagggaactttattagttcctaactttgtcttatacgaactacaatacattgccgattctgctgatagcatcaagcgggtgcgtgggcgccgaggcttagacttcttaaacaagcttcaaaatgaaaaaattatgccaattgaaatgtacgatggcgattatgaagaaattgaagaagtcgatagcaaactaatccaacttgctaaggacaaggacgccgtaattgtgacgaacgattataacttgaataaagttagtcaatttcagaatgtccaagtattaaatatcaacgagttggctaatgcgttgaaaccacgagtaattccaggtgaaacgatgaaagtacacgtcgttaagaatggtacagaacgtcaacaaggggttgcctatttggacgacgggacgatggttgttgtggaagatggtaagttttatatcagtgaaacaattgatgtcgtggttacgagtgcaattcaaactgatgcgggtcgaatgatttttgctaaaccggttcactccactaaggaaattacccatagcaaagataagacagaatagactttatttattattgatatcaatgtagaatgaaaacattgtgacataatttttggagaggtgttaattttggcaaagcaaaagattcgagtacgttatgctccaagtccaacgggacatctgcatatcggaaatgcacgaacagccttatttaattatttgtttgctcgtcattacaaaggtaaatttattcttagaattgaagatactgaccaaagtcggaatatcgctgacggagaaaaaagtcagatcgataacctaaaatggttgggaatggattgggatgaaggtcctgataaaccgggagaatacggtccttatcgtcaatctgaacgtaaaggtatatatcaaccactaattgatcagttagttgctgaaggtaaagcatatgaatcatatatgactgaagaagaactagctgctcaacgtgaagagcaaaaggcaaatggtgaaatgcctcattatgttgatgaatatgctggattatcacctgaacaaaaagaacaaaaaattgctgatgctaaggcagcaggaattgaacctgtaattcgttttaaggtgcctaccaacactacttacgaatgggatgatttggttaagggtcatatttcatttgaatctgaaacaattggtggcgattttgtcattcaaaagcgtgatggaatgccaacttacaactttgcggtagttgttgatgatcatatgatggaaattagccatgttttccgtggggatgaccacgttgcaaatactcctaaacaattgatgatttatgaagctttaggatgggatgctccccaatttggtcacatgagcttaattatcaatactgaaacaggtaagaagttaagtaaacgtgatgaatctattcttcaattcatcgaacaatatcgtagtttaggatatctaccagaagcaatgttgaactttattatcttgcttggctggtcaccagtgggagaaagtgaaatctttacgctacgtgaattcgttaagatgtatgatgaaaagcgtttgagtaagtcacctgctgcttttgatgctaagaaattggaatggattaacaaccaatatgttaaagctgctgatgaagatcgtatcatgcactcagcactccttcaattgattaatgccggtaagattgaaaagaacccagcaccaatgaaggtagaatgggcacgtaagttaatcaacttatttaagcgtcaaatgagttatacagcgcaaattgttgaatttacagaattattctttaatggtcctgaaaatatcgatgaagaggctaaagaagaattggccacggatgatgctcttccagtattaaaagcattggaaaaacaattcagtgatttgccagtctttgatacagttaacattttggcagctattaaggcggttcaaaaggaaactggaattaagggtcgcaaactttggatgccaattcgaattgctattacccatgaaatgcatggacctgaacttccagaaagtttggaattattaggttatgaattatcaatgcaacatttacgggcaatgattgaagaattaagctaaatatgaaagaagaactccaataaagttaggtgggagacatggactccgctaccaaacgttgatgcttggctcagcgactaaaacttttttgaagctcttcttttttatattcactttgcgttgcatactcttttcaattatcattagagatagctaaaaatccccgtagggagtgaaaaaatgattaaaatttataatacaatgtctagaactaaagaaactttcaagcctttagtggatcataaggtatcaatgtacgtttgtggaccgacagtatacaactatattcatattggcaacgcgcgtagtattatcgcctttgataccatcaggagatattttgaatatcgcggatttgaagtgaaatttgtttcaaattttactgatgttgacgataaaatgattaattcagctcgtgaacaaggtattacagttccagaattagcagatcgttatattgaagcttttaaagaagatgtccaagctgttaatgtagaaccagcgacgcttaatccacgggctactgagaatatcgatgatattatcgcatttattgcagatttgatggataagggctttgcctatgcggtagacggcgatgtgtactatcgggcacgtaagttttcgaagtatggtgctctttcacaccaaaatattgatgaattagaacagggtgccagccagcacgtagatgatgaagaaacagctcgtaaagaagatccaattgactttgcgttgtggaaggcagctaagggtgatgaaattgcttggaaagcaccatggggaaccggacgccctggatggcatattgaatgttcagtaatgtcaaccaaatatctaggagatacttttgatattcatggtggaggagaagaccttcaatttccgcatcatgaaaatgaaattgctcaaagtgaagccaaaactggtaaacagtttgctagatactggatgcataatggattcgtcacagtcggtgatgataacgaaaaaatgagtaaatctttgggaaactttgttacggtgcacgatttagttcaaaaaataaatcctcaagtcttacgtttcttaatgtcgactactcaatatcgacgtccaattcaatatacacaagcaagtttacaagacgctaaaaacaatctagaaaagctacaaaatgcttttatcaatttgaattatcgtttgcaaggtgctcaaggggcagctgacgcaacgattgctgaacaggctgctcaattagaaacagactttattacagcgatggatgatgactttaatgcccaaaatgggattaccgttgtttacgagtttgcacgcttaatcaatgtatatagtgaaaaaacagccgtgaatgctgagcaaattaatcaattattaaccagctatgctaaaatggcagctgtttttgggattgaattgaaacagattgaaaatgatgatgctgaaattgatgaattagttaaacaacgcgatcaagctcgtgcagaccgcgattttaagactagtgatcgattacgtgatcaattaaaggaaatgggtgttatcttagaggatacgccacaaggaacacgttggagaaaaaaagatgagtgaagagtttaattaccaagcaattaatggaattgcactagcctatttgggtgatgcggaatacgaagtttttattagaagacatctaatcaaacaagggtttacccgtcctaatcggttacatcacgttgcaaccagatatgtatctgctaaggcacaagcagctttaattaacgcaatggaagcagaaaattttcttactgaaaaagaaatcgaagctttcaaaaaggggcgtaatgctaaaagtcatacgtctgcaaaaaatacatcagtccttacttaccgaatttcaacgggatttgaggcaattgttggatatctgtcattgacaaatcaaactgaacgtttagctgaatttgctcaatggtgtattgaaaaagtcgaggaaggaaatttacgtattgaataattcaaatgaaacgcaacaaccagattttgtcattggccgccatccagcaatggctagtttgcaaagtgatcattcaattaacaaggtttttattcaagaagggctaaaatcggatggaattggacaaattattgctaaagcaaaaaaacaaggtctggtaattcaacgagttactaagtcgaaattggatacattatcgaacggacaaaatcaccaaggggtggtactagcggttgcatcctttgaatatgctgaattagatgatatcttcaagttagctcaagcgcgcgaagaggaacccttcattttaattttagatggaattgaagacccgcataacttaggttcaattttgagaacggcggatgcagcaggcgttcacggagtaattattccaaaacgacgggcggttggtttaaccagtaccgtagccaaaacttctgcgggagcaattgaacgagttcccgttgtccaagttagcaacttagttaacgcgattaaagaacttaaagaacgtggactttggatttttggcactgatatgaagggaacagattatcgccgctgggatgcaaaaggggcggtaggtttgattatcggtaacgaaggaaaaggtatggcccgcctaactaaggataatgtggacgaaatgttaacgattccgatggttggtgaaattcaaagtttaaatgcaagtgtagcagccggacttttaatttaccaaggctataattcaagacatcaactttaaaaattagaaacgaatgattggaatgccaattattcgttttttatttacgaaaaatgcggttagaaaattttaacaaccttgctaagatcgtttccattgaaacagggaggaagcgtaatggcgaaacaaggtagtttggaagaattggatgagcttgaaatagttcaacaaataaaaaacaatgattcaagtaattttgaaattctatttaagcgatatattccaattattaaaaaattaagaacaagatattcgattcgtaatctagaatgggatgattggttgcaagaaggacgcatcgttttcttcaactcggtagttaattttgatgaaaatttaaaaattactttgggggctttttttcgaactaattttactaatcaaatttatagtatcttaagatttgagatggcctataaaagaaaagcgggtttgacggcgcaatcgatagaaagtgtcgatggtgatttagaaacagcaactaagaaaatttctaagattacaccgcatagtaatttagtcattaaggaaagttatgcggaatatgaatcattattatcaaaatttgaaaaagaagtttcagtgctcttgtttaaaggaaattgcccagaagaaattgcggaaaaacttggttatgaggtgattaagatccaaaatgcgatagtacggtgtaaacaaaaattaagtgaacaaatgtatggtcgcccttaattgacaatcggggttgcacatgctaaagtttaatttcgataaggagggattttttatgtcccaaaagaaagtagctttagcatgtactgtttgtggttcaagaaactacacagtagcagctagcccgcaaagaacagaccgtttagaggttaataagtactgtaaacgttgtaacaaacacactttacacagtgaaacaagataggaggcgtattaaatgtttcgattttttaagagcattggtcaagagatgcgagaagttgactggcctaattttaaacagttaagaaaagactcttccactgttatttcaacatcggtattttttatagccttcttagctttagccgattggctaattcaattgttccttaagctatttgtataatggcataaggtcgattattttgttataatttaatttgttgatagaaacttcgtgcttacggagtttttttattttggaaaaggagcgcttaacttggaaactgaagaaaaaaactggtatgtgttacatacatattctggatatgaaaataaagttaaaaataacttggattcacgtgctaaatcaatggggatggcggaatatattttccgagtagttgttcccgaagaagaagaagttgaaactaaaaatggggaagacaagattgttaagaagaatgaatttcctggctatgttttggttgaaatgattatgactgatgattcttggtacgtggttcgtaatacaccaggagttactggatttattggttcccatggttctggtagtaaaccaactccacttttaccagatgaagttgaacgtattcttcgtcgcctaggaatgactgctcgtcatgctgatatcgaagttgaagtaggcgaattagttaagatcgtcgacggtgcttttgaaggtttgactggtaagattactgaagtcgataataacaacatgaaggttaaagttaacatcgatatgttcggtcgagaaactagtacagaactagatatcgaacaaattgataaaattgactagattttaatttgaacaaacatttcgggtgtggtattatatcgtagtatgccttgcatactcaatgtgggagaagaaatataaatcttcatcgtgaccacacacggacttattttaaggaggtatgtctcgtggcaaagaaagtagcaaacattgttaaattgcaaattcctgcaggaaaagcaactccagctccaccggttggaccagcacttggacaagcaggtatcaatattatgggatttacaaaggactttaacgcacgtacagctgaccaagctggcttgttaattcctgttgtaatcacagtttacgaagaccgttcattcgacttcgttacaaagacaccacctgcttcagttcttttgaagaaagctgctggtgtagaacacggttctggtgaacctaacacgaacaaagtagcaacagttacttctgctcaagttaaggaaatcgctgaaacaaaaatgcaagatctaaacgctgcagacgttgaagctgctatgcgcatgatcgaaggtacagcacgtagtatgggattcgtagtcgaaggctaatacacgcactgtcggatactccactaaagtggatgtatcaaagtgggaggaaaatccgctataaccacatttgctaggaggaaaacacacagatggctaaaaaaggtaaaaagtttcaagacgctgcaaaacaagtagaagctcttaaggcttatgctccaaaagaagcgcttgaattagttaagaaaattgattttgcaaagttcgacgctactgttgaaacagtatacaagttgaacgttgacacaaagcaagctgaccaacaacttcgtggtgccgttgttttaccaaacggtactggtaaagaacaaacagttattgtatttgctaagggtgctaaggctgaagcagctaaagcagctggtgcagatgttgttggtgacgacgacttagtacaacgtatccaagacggatggttagactttgacgttgcaatcgcaacaccagacatgatgggacaagtaggtcgtttaggtcgcgtattgggacctaagaacttaatgcctaaccctaagactggtacagttactatggatgttgaaaaggctgttgctgattctaagtctggtaaggttacataccgtacagaccgtgacggtaatgttcatgtgccaattggtaaagtatcatttgatgttgaccaattacttggtaacttacaaacaatcaacgatacaatcgttcgtttacgtcctgcatctgttaagggtgcttacgtacaaaacgtatcagttgcatcaacatttggaccaggagttaaggttgacttttctcaattctaaaatctcttgatttgttccaaacgctgtgatatattactaagagtgaattataactgaataatttacctaagactcaggtggtcatgtttggccttaatatattgcctgccgaggaacgtatgaaactattcgtgtctcagagtctttctggggtacgaatttttttatggttcaacaatcattcaggaggtgaaatacattgagtaaagaagctatcgcacaaaaagctgtaatcgttgatgaagttgctgaacaattaaaggaatctgtttctgctattgttgttgattcacgtggtttaactgttgctgaagtaacagacttacgtaaacaacttcgtgacgctggtatcaagctacgcgttatcaaaaacaaagtgttgacacgtgctgctgaaaaagctggttttgaaggtatggacgacgtgttcgttggtccttcagccgttgctttctcagaagaagacgctgttgcacctgctaagattttgaagacttttgctgacagtaatgataacctttcaattaagggtggtattattgaaggtgaagttgctgatatcgatacaattaatacattcgctacattgcctagtcgtgaagacttgcttgcaatgcttgctaatgaatttatgtcacctgtacgtgacgttgcatatgcacttaaagctgttgctgacaagaagtctgaagaagacgctgcataagcaaataacatttaattataattaatttggaggaaacaaaaatggcattagataaagaccaatttattgaagacttaaaaggtgcttcaattactgatttaaacgatcttgttaaagcaatcgaagacgaattcggcgtttcagctgctgctccagttgctgcagcaggtgctgctggtggcgctgctgaagctaagacttcattcaacgttgaacttacttcaggtggttcagctaagatcaaagttatcaaagcagttcgcgaaatcacaggtgctggcttgaaagacgctaaggacatggtagacaacgctccttctgtaattaaagaagacgtttctgaagacgaagcaaacgaacttaaagctaagcttgaagaagctggcgcaactgtagaagttaagtaatttaatttcttaagttagtaaaagagctatttccatttggatggaaatagctctttttttgttttaaaaaatattcaaataaagactttttgataaataggatgacagagcgttacaaaaaatccaacttctaaaatggaagttggatttttttatttggatttaaatgttgtaatcttcatcactcatagtttccacgttacccaaacgataaccgttaccaacttgtgagaagaagtcatggttagaagttccagttgaaatcccattcattacgatgggattaacatcagcttcagtatcagggaacaatgggtcttgccctaaattcatgagggctttgttagcattataacgcgtgaaggtaagaacttcatcagtccaaccaacttggtcatacaaagtatgaacatatttttcttcgttatcatataaatcgtataagaagttatacatccaatcctttatttcttgctgttcattttcaccaagctctttaagacctaattggaatttgtaaccaatataagttccatgaactgattcatcacgaagaattagtttaataatctcagccacattgtttagttgattatgacctaagtaataaaggggagtgaagaaaccagagtagaataagaaagtttctaaaaatacacttgaaatctttttcttcaaaggatgttcatcatcatgatataactcatagattcgtttagttttattttgaaggaattcttctgaatcactccaagcaaaaatttcatcaatttcagagggagtatttaaagtctcaaagattgatgaataactcttagcatggaccgattccataaattgaatgttatttaacactgctgtctcgtgaggagtgcgaatatcctttctgagagctgccattccgtcttgtgattgaagagtatctaacagagttagaccgccaaatacgtgacctacgacccatttgtggtcttcgtctaattcacgccagtcactaagatcatttgaaattggaatacgggtatcgagccaaaattgttcagtcaacttttcccaagtagctttatcaatttggtctgaaatggcattccagttgattgcttcatagttttccattaaaaaatcctccacttatttaaattgaacagctttcacattgatttacgccaacttcaccatcattatctgtgaaggtacgaacgtagtagatggacttgataccttcatgatgggcatagttacgaaggatattaagatcacgagtggtcattttatcagtgcggccttccttccaatcataaattccagctggaattgttgaacgcatgaagaaagtcatactcatcccttggtcaacatgttgttgggcagcagcgtaaatatcaataactttacgcatatcaatgtcgtaagctgattggtaatattttaacgtatcattggaaagatatggagctgggaagtaaattttcccaattttcttttcttgacgctcttcaattttgttaacaatgggttggagactagctgtcgcatcgttgatataagaaattgaaccagtaggagcaactgccattcgattttggtgataaagtccgtcagccatcacatcagctttaagttgcttccaatcttcaacgcttggaatttcaatcccattaaataactctttaactcgattggatttaggtccaaaatcattttctacatatttatcaaagtaagaaccatcagcatatttgcttttatcaaagttgtggaaaacttgattcttttctttggcaatctggttagaagcttttagagtccaatagttcaacagcataaagtaaacactagtgaattcaatcgaatctgcttcaccatagtaaaggtggttcttagctaagtaaccatggagtcccattgctccaagaccaatggtatgagcaagagcatttccgttttggatagaaggaacaacgtcaatatcagaatgatccgtaacaaaagttagcgctctaaccatagtttcgaccgatttaccgaagtggggcgtttgcatcatattaacaatgtttgttgaaccaaggttacaactgatatcagttcctagtttcgtatagttttgcttgttatcaattacggatggagtttgtacttgcataatttctgagcagagattactcattacaatttttccataaattggattttctcgattagccgtatcaacgttaacaatgtaaggatagccagattcctgttgaagtttagaaatttcattttcgatgttacgggctttaactttgaatttcttaatagcagggtttttgaccatgttgtcgtattctttagtgatatcgacgtaggcgtaaggttcaccgtaaactttttccacactataaggactaaatagatacatatcttcgtcgtgtttgatgaggtcataaaatttatcgggaacgactacaccaagtgagagggttttaacccgtatcttttcgtcggcattttcctttttagctgaaaggaaagatacaatgtcgggatggaaaacgtttagatatacaacaccagctccctgacgttgtcctaattgattggcataagaaaaactatcttctagtagtttcataaccggaaccacaccgctagcagcgccttcaatccccttgattggtgctcccgcctcacgaaggttagtgaggttgattccgaccccgccacctaatttagaaagttgaagagcagaattaatcgtacgaccaatcgagttcatatcgtcattagcttgaattaagaaacatgaaactaactctccccgatgcttacgaccggcatttaaaaaactaggagtagctggttgatagcgttggtgaatgatttcatcggcaatattcatggccaattcttcattaccatcagcaaagtagagagcgttcatagccacgcggtcgatgaagttttctaaataatattcgttattattcgtttttaaggcatattgagcgtaaaacttataagctgccataaacgattgaaagtggaagtcttgttgctttaagaagtcgtacagtttttcgataaaatcgaatgaatattcttcaacgagggcagcctcgatatagtcttctttgaggaggtaatcgaaacgttcacgtagagaatcaaattgcatggtgttagcttgaacattctcttttagaaatgcagctagagcttcacgatccttgcttaggggaatttggttatcaacagggatgttaatttcattgtttaaatcatagtaagtaacatcttttagatcttttaaagtcataattcgaatcctctcttcaatcaagtgaaataaaaaaacgctccgcatttacaatgtacgaatggggcgtcttgaacatctgagttagcgttggtggagaactaaattgctaatttttttagtaaatcgggtctaaaaccagccacaactttttcttcagaaaattgaacgactggtacggcttggaagcctttagcttttaaagcgtcgatatattctggatttgcattgatattacgttcttcaaaagtaaccccgttttcggataagaagcgtttagtcattttgcattgaatgcagttatttttagtgtacacaattatttttctcataatactgatcccccttgtctcatttatcatggaactaagtatacaacatttattactaaatttgaaataaaaaagcacaatatgtagaggatatatttttatgatcccactatatattgtgctggcggtgtttattaaattttattctttttaaattggtaactgaatttacaatacgatattatattaatagagaatggaggacttttcaatgacagattattattttactgaaaatcccaacgccgaacatgacgagaagcattggagctacgagcttttgggtcataaattaaattttatttcggatcgcggtgttttttcaaaaaacacaattgattttggaactaggacgttgcttgaagcaatacaaattgtaggttctgctgaaaagattttagacgtgggatgtggatacggtccaattggcatatcacttgccaaaagttttccagagatacaagtacagatgacagatgttaacgaacgcgcgttgggactcgccaaacgaaatgcagttgctaatagcatcgaaaaacagactcaaatttataaatcagatgcatatgagaatatcgatgatacggatttcaccatgattatttctaatccaccagtccgtgcaggaaaatcggtagttgagacaattatcgttgaggctaaatctcatttaaaagcaggtggccaactggtaattgttcttcagaaaaaacagggggcgccctcagctaaaaaattaatgcaagaaacctttgggaatgtcgaagtcctaaaaaagaataaaggatattatattttaagaagtgcacatgaataagttaacagagcatgaaattaatttttatatgaatgaagcaattaaagaggcccaattcgccaaaatgattgatgaggtccccattggagcagtggttgttcatgatggtaaaattatcggtcgtggtcataacttaagagaacactcacaggattcaaccactcatgcggaagtcttagctattacggaagcttgcgcttatttaaaaagctggcggctgtgggattgtcagctttttgtgaccattgaaccatgtttaatgtgtagtggaaccatcatcaattcacaattacctcaagtattttttggtgctcgagatcctaaagcaggagcggttcgaagcctgtataccgtactcgaagatacgcgtttaaaccatcaagtagcggttcatgaagggattgaagctgaccgagcatcgatgttaatgaagacgttttttaaagaaattcgaaaaagaagaaaaaaaactaagtaaaatagtggaaatttttttaaaattcgagtatcatagttattgccgtaaggccttgaggcaaggttggacttacgaattgtgtcaggtccggaaggaagcagcactaagtatgctctggcttgtgccttaagttattgggtaaattaacgaactcttagtccattgggctaagggttcttttcttaaaaaaagcaaatatggaaggaaatcaaatgagttatcaagcattataccgtgtttggcggcctcaaaagtttgatgatatggtcggtcaagacgtcgtcacgaggactttaaaaaatgcattaataactgagcagaccagccatgcgtatctatttactggtccacgaggaaccggaaaaacatcggcagctaagatttttgctaaggcggttaattgtcactatcttaaagatggtgagccttgtaatgaatgtgtgacttgtaaagcgattactgagggaaccttaaacgatgtaatcgaaattgatgcggcctcgaataatggtgtcgaagaaattcgcgatattcgagataaggcaaagtatgctccaactgaagcagactacaaagtctacattgttgatgaagtccatatgctatcaaccggagcatttaatgcgttgttgaaaactttagaagaaccaccagctaatgtaatttttattttagcaacgacggaacctcaaaagattccattaactattatttcaagaacacaacgttttgattttaaacgaattacaccagctcaaagttatgatcgcatggtctatattttggatcaaaagggaatccaatacgatcaaaaggccctagcaattatcgccaaggctgctgaaggtgggatgcgagatgcgttaagtattttggatcaagtgatctcatttggtaacgaagaagtaactttagataacgccttattagttacaggaagtgttaaccaaaaactattagatcagtatttaacacaaatttttaagcaagaaacatcagcggcgttagaaactttgcatcaaattttagatgagggtaaagatggacaacgattaattgaagatttaattgctgttcaaagaaatttactcttataccaagaagatccccagttggtgcaagaacaaagcttgaatgatctatcggaagcttttactgaagaagcagctatggtgactggcgtggatctatatcagatgattgatacgttgaatagtattcaacaacaaatgcgcttcacgactcacccagatgtctatttggaagttttgacgattaagctatcacaacgaaaaactgcgaaagtttccaccgaagccccaaccggttccgtggataaccaagaagtggagcagttacgttcagaagtcagtcaattaaaacaagcaattcaaaagctacaacaaaatgtaaaaaatacgccaagtaattcacaatcagctcagcctaaacctaagaaaaaagcggtaggtgctaaacaagttaaaactccggctaatttaactaagatttatccgatcttggaaaatgctactaaggccagtttaaatacgatgcaggaactctggcgcgacttaatggatatgctatctgttacagaacgggctttaatgcacgtttctaagccagttgcagctagtaaagaaggagtggtcgtagcgttcaattacgactttctgtttgaaaaggccgtcgataatgaagtgcttcgtactgaacttcaacaaaatttagctaagttaactggttccgattttaaggtagtttatgttacagttgaagagtggccagaggtgcggtcaggtttcttaaatactcatcattttgataagaatcaagaaaaatctgaaccagaggcatcagagcaatctacacccaaagcggatgaagataatcaagctgttaaaaaagcggtcgaattatttggctctgaaaatgtaaatataaaaaatgattaaaggatggtaatacaaatgcgtggtggaatgggaaacatgcaaagcatgatgcgtcaaatgcaaaagatgcaaaaaaaggtaacagaagaacaagaaaaattaaatcaaactgaatttacgggtgtggcaccagatgacatggtcaaagttgtattcaccggtgatcatagaatgaaagacatcgtgattaatcctgaagcaatcgatgaagatgatccagacatgttacaagatttaattgtagccgctgtaaacgacgctatgaatcgtgtggatagtgaaactaataaaacaatgggaaaatacactaagggcatccccagaatgtaattaagaatcgtaggtgatagaccgttatgcaatatccagaaccgattgcgaaattaatcgatagtttcatgaaattaccaggtattggttataaaacggcaacccgattagcattttttacgttagatatggaaaaagatgatgtaaccgaatttgctaaggcgctgatttcagcacaacgggacctaagtttctgtagtatttgtggaaatattacggaagatgatccatgtgatatttgtcaggacccttcacgagatcaaaaagcggttttagtagtcgaagattctaaagacgtaatgtcaatggaacagatgaaagaataccatggtttgtaccacgtgttacatggcgtgttatcacccatggatggtaaaggccctgaagacatcaatattgctgcgttacttacccgtttacagaagaacgaggccattaaagaagttattattgctacaaatgcaactccagaaggggaagcgacagcgatgtatatttcaagattggttaaaccgtccggcattaaagttactcgtttagctcacgggttatcggtcggaagtgatattgaatatgcggatcaaatgactttatataaagcggtcgaaggccgaacagaaatgtaaagcaaaataattaaaagatgagttaatgcgattttaccaacgcgttagctcatttttttaaattaatatggtgatattttaattaaggttaatagacagtccttaaaatctaaagtagaataaaaacaataaataatttaaaacaagtaaggcggggaatactggtgaacgggcattttatatcatttgaaggtccagatggggctggaaaaacaacggttctgcaagcgatggtcgaacattaccaacagcgtttgaaggaacaattaacagtaacgagggagcccggcggaaatcctatttcagaggcaattcgaactattattttggataaaaacaacaccgagatggatgagcgaacggaggccttactctatgcggctgctagacgacaacatttggtggaaacgattttaccagctttgaaaaaaaatcatgtggttttttgtgaccgatttgttgatagctcaattgcatatcaaggagcaggcagaaaaattggtaccgatgccgtctatcaaatgaatctctttgctactgaaggagcattaccagaaaaaacaatttacttggatgtaccatcagaacttggactaaagcgcattatgactcatcggacggaagatgttgatcggttagatttagaacaattagattttcatcagcgagtccgttcggcatatctagatttagctaagaaatttccaaatcggattgtcgtaattgatgcgagtcaagaacttgatgatgtaaaaagagatgtaattgaagtgttagaccaaattttaaattagcggaggaatattattatggcaactaagttagttatcgcaattgtacaagataaagatgcaaactatttgagtgatcagtttattgatcaaaatgttcgagcaactaagttatccacaactggtggttttctacaatcaggtaatacaactttcatgattgggattgaagaaggacgtgtcccagaagtccttgaaatcatcaagaaagctagtcataccagagaagaatttatgacaccatctgttaacatggacgttaatatggaaggtactacggcctatccaattaaggttcaagtcggtggtgcaaccgtccttgttcttccggtagatcaattcgagcgcttctagtggaagatctgaaaaatttaactaatcaggctgtggaaaaacaacctgaaattgttaaacgctttaatgaaatgattgatagccagcatttgtcgcatgcctacctgttaaccggagcaggtgggattggaaaaaaagacgtcgctcaatgggtagcgatgcgtcttttttgtattgacttacagggatcaatgccttgtggagaatgtgaagagtgcactcgaatcatatcaggacaacatccagatgttgtagaaattgcaccagatggccaatcaatcaaggtggaacaagttcgttttttaaaatccgaattctctaaaagcggggtagagggcgcacggaaagtttttattattgaacaagctaataaaatgacaacgagtgcggccaatagtttgctgaagttcatcgaagagccttcaggagaggtaacggcgtttttactttctgaaaatagaagtttgatgctaccaactattgtgtcgagaaccgaaattattgaactaaaaccgttacctaaagatcgattgattaaggaattgacagagcaaaatatagctgaaacggatgctagaattttaagccggttaaccaacgatacgagtgaaattcaaacactggtagataacaactggattttggatgcccataaggcgttagaaaagtggtttataacggccactactggggacataactgcatttgtagacgttcaaactcgagtaatggctttggctaaggatcgattttatcaagaaaaaatattggacttgatgatgttatatgcaatggacctgttagaactaaagtttgatcaagaaacgattacttatgaagctaatcgacgtcagttacaagagttagctgatcagaccaacgtccgtcaactattggctgttgcagatgtattgctgcctttaaaacatcagttaagtcagaatttaaattttcaaagcgttgtggaaaaagcaacgattaaaatatgtaatatattcaaaatgagagggcgatagtgtggataaaaaagatttatttgatcaaataacagaagtcacgcgaaatactgaggatttgttaaataaactacacgaaacccaaagtgccatggtggaaatcatggaagaaaatgctgaacttcaaattgaaaatcaacatttgagagagcgtctaaagcaagcaaccgctgctgaaaatgaaggaactaagaacacaaaatatggtttatcaaagtcacttcaaaacttagaaaaattatatgcaagcggatatcacgtttgtaatgaattttacggtaagcatcgtcaagatgaagaagagtgcgcattttgtttaaccgtcatctatggagatcgctaatatgttaacgcaaaaaagtttcagccaatcgaatgaaggacgattatatctggtaccaacgccgattggaaatttagaagatatgactttcagagcaattaatattttgaaagatgttgatttaatcctagctgaagatacacgaaatactcaaaaactactcaaccactttgaaattgataccaaacagatgagcttccatgagcacaacactcagcagcgcattccaacaattttgaaaatgttagaagatggtcaacaaattgctcaggtatcagatgcggggatgccatcaattagtgaccctggtcaagagttagtaaaggcagcagtatcacaacaccttaacgttgtacctttaccaggctcgaatgccggaattacagcattaattgcttcaggattagttccccaaccctttactttttatgggtttctatcacgcaaaactaaagagcaaaaagaagagcttgaagttttaaaaaataatcctaatacagttatcttttacgaagcaccgcatcgtttagctaagaccgtcaaacaaattggtagtagtttcggtacgacccgtaaaatggttttggcacgcgaacttaccaaacgctatgaggagtttattcgtggaagtattgaagaagttcagcaatggattgctgaaaatgaagtacgaggcgaatttgtagtgatggtcgaaggaaatgatcatccacaggttactaccaataacgagtgggaaagcatgacgattaatgaacatgtgcaaaaaattatcgatgatgaacaagttaaaccaacaattgcgattaaacaggtcgctaaattgcgaggtttaagtaaacaagaagtttatgacatctatcatcagttagagcaataggagagaataatggctggaaagatacatgaagaacaacatttagtaacgcattacgaaggtgaccagaccggaacaatgaaagttcccatgattattaacgccatgttgttaacttcggataatcaaagtcagcaactaggtgttggaaatgcagttgtggataaaaccggattaggctgggtaattacacagtacgtgctgaaaatcaaacgactaccacgggttggagaacaaattgtagtaggaactagagcagttaataacaatgattatttctgccaacgggatttttgggttaaagatcaaaaaggtgaagtgattgtggaaaacacttcaatttttgtattgatggatcgaacaacgcgaagaatgcacaagctcctacctgaaattattgaaccctatgaagctgaccaggttaaacgtattgttcgtttgcctaaactggaaaccatcgaaggagcatcagttgctaaggatttcagtgtagaatattttgatattgatccaaatcggcatgtgaataatgccaaatattttgaatggatttttaatacagttgatcaagatactctaaataactattatccagcgatgattaacattcgttatcatgtggaaatccaacctaaccaagttgcccatagcacttttacgatggatcatgatacactcaaaagtgatcataaaatttttgctaatgacactttgtgttgtgaagcaaatgttgaatggaatcaccgttaaggttacaatgagcgtagtttaaattttacattggaggatgaatgaatgagtattcttgtagttggaggagccggatatattggttcacatatggttaagcgattagtcgaacaaaatcgagatgtagtcgttgtggataacttatcaactggtcatcgtggcgcagtggataaaggcgtaaaattttatgagggcgatatccgagatcatgcctttttaaaggaagtctttgatcaagaagcaattgacacagttgtgcattttgctgcattttcaattgttcctgaatccatggaaaaaccgcttaagtattttgataataatacggcaggaatggttgctcttcttgaagaaatgcgggatcacgatgtaaaacgcattattttctcatctacagctgctacttatggagttcctgaaaagtctccgatcgaagaaaccgaccgtcaagcccctatcaatccttacggtgaaagtaaattaatgatggaaaaaatcattaaatgggcggatcaagcttatggaatcaaatttgtagccctccgctactttaacgtagcaggagcctatccagatggttcaattggcgaagatcatggaccagaaactcatttaacaccaattatcttgcaagtggctttaggtaaacgtgaccaattacaaatttttggtgatgactatcatactccagatggtacgaacgtacgtgactatgtgcacgttttagatcttgcggatgctcatattttagcaatcgattatcttaaagcaggtaatgatagcgacgtcttcaacttaggttcatcaactggtttctcagttaaagaaatggttgaagcagcacgtgaagcaactggtgaagccattccagctaaaattgcggctcgtcgtcctggagatccagattcattaattgctgcaagtcaaaaagcacgcaaaattttaaaatggaatcctcaatatgatgacgttaaagaaatcattaaaactgcgtggaattggactcagaaacatcccaatggttatgaagaccgctaaaataaacgtataaataattttaattgaggttatgacataaaaatttgtcataacctctttaattttgaaagaaatgaccttgaaaggacgaatttattctttgttgtcgtcatcactattctgtaggataatatgtagaggaattaaaagggagcgaactgaatgaagattttagctatggatacgtccaacgttactttaagtgtagcggttttggattcagaacaattactagctatgcaaaccactaatattaaaagaaatcatagtaaacaactgatgccaattatttcgcaaactcttgcagaagcagggatggcactaaacgaaattgaccggattgttgttgccaaaggaccgggctcatatactgggttacgaatcgccgttactacggccaaaacattagcattaacgttaaatgctgagttagtaggagtatctagtttagaaatgttggttcctaacgcacctcaaaatggtttagtagtcccattctttgacgctagaaatggaaatgtattcgccggaatttatgagaaagatggagaacaagttgtaaacgtactagcagaccaacatattagttttgaaaaattattggctaagattaatgagttaggtcgaccagtttactttgtatcttctcaatttgaacaatttcaaacaatggtagaaaatacgttggttgttgttgcagaacattctggaaaattaaacagtttaccaaatgcgcatgcattaggaatcttaggattacaaaaaacagaacttgaaaatgtttatacttttgtaccagcttatttacgagtgacagaagcagaaagaaattggaaggaaaagcatccaaacgatgaaaacaaagaatcatatgttagacaaattaattaattgggctaaatacactttttttaatcggacacgacgtttgcgtgaggaggcttttgaaattaaacaccataatgttgtaatcgaaggtgaaagatattttgtagcgcaggctactaataccgatattccggagatattaacggttgaacgtgctgtgtatgacggacaaaccccttgggatcgaatggcctttgccaacgaattgcgaagaaaattagaccgattatatttagttattaggcataatgaccaactgttgggctttatcggagcttcttttgatgatcgtagtaaaatggcgcacattactaatgtagctatcttaccggaatatcaaaaccgtggtattggatcgtttctaattgagtcgattattaaaaaagctcaatttattgaatacaaatcaatcactttagaagtaagaaaaagtaatattacagctcaagcattatatttaaagattggttttgaaaagacaggaatcaagaagaggtattatttcggcgatcatgaagatgcaattgatatgacattagatttgtcgaagtggcgaggaggatatcgtggatcaaactagtttaattttagcaatcgaatcaagttgtgatgaaactggtgttgcagttattaaaaatggtgacattattttatctaacataattgcaacacaaattaatagccatcagcgctttggcggggtggttccggaagttgccagtcgccatcatatcgagcaaattaccatctgcattgaacaagccttaaagcaagctgaagtacgtaaagaggacctcgatgctgtagcagttacgtatggacccggattagttggggcacttttagtgggcgtttcagctgctaaagcttttgcttttgcaaatgaattaccattaatcccagttaatcacatgattggacatatctacgctgcacgctttgtaaaacccattgtttttccagccttagctctccttgtttcgggggggcatacagaactagtatatatgccaaccgaaaatgaatttaaaattatcggtgagactcgtgatgatgcagccggtgaagcctatgataaagtggggcgcgtaatgggtttgaagtatccagcgggtaaagcaatcgacgaacttgctcaccaaggcgaagacatcttcaagttcccacgagcaatggaacacgaagataattttgattttagtttcagtggtttgaagagtgcttttattaatacagtgcatcatgcagatcaaattaatgaagaacttagtaaaaaagatttagcagcaagcttccaacaaagcgtgatagatgttatcacggctaaaacggttcgggcttgcgagcagttagaaataaaacaattaattttagctggaggagttgcagctaaccgtggtttacgggatactttagataaagaacttggcgaaaaatttaatcatttagatttcgttaaggcacctttggatctttgtggtgataatggagcaatgattggtgctgctggtgaaatgttaatgcgacaccaagtttttgctgatatgacgttaaatgctgatccaagtttagaatttgattgggaaccagaagcaattaagtaaagagtgggtgaataaatatgactgagcaaatgcatcaagttcatcaagttattaaaaaggaaattgaaaatcataatatttatggtgcttcctatagcttgattacgccaaaagaaattgaaaatcgttatgaaggtgtccaaggagaaggaccatctgccgttttattagatccttcaatgatttatgacctaagtacaatgacagaggtagttgcaaccacaactcgaatttttcaattacttgcaattcgagaaattggcttaaaagatccagtcactaaatatttacctggtttttcaaatcgagatattacaatcctacatttattaacccatactagtggattaccagtaacggttaataaatcgaaacattttacaggaatcgaatttactaacgcactatattctgtcggtctagattttaaacctggtgaaaaaatgcaagtttcaccacttaattttgtggtgctaggaattattattcgaacagtagacggttccattgatcgtgctgttcaagatcgcattttatatccactagcaatgactaatactggttttaatttaaaccgtcctaaggctcgctttgtaccaactagaaaagatgctaagcgaggacaaatccaaggacaagttgaagatcaattgggcttgttgttgaatggggaaagtggttacactggattattttcaaccttgaatgatttaacagtatttgttgaaatgatgttaaaccgtggtaattatcagggaaaagaagtccttgatccacagctatttgatacgatggaaaaattcaacattgatgggcaatcacttggttggagtcgttttagcgccaatgctgacgtattttatggcagtagtccaactggggttatcgcatttaatgttaagaaaaagcaaggtatggttgttcttcataactttgtggaaaataatcaagttcatgccaaaatgttaacaggattattaaaggtaattcagtagaaaaggtggaagaaaaaatggatgataataaaatctcattggcagcaactcgtcgtttaccattatactaccgttgcttgagtgaactaaatgaaaaaggcgaagataaagtctcttcagccgttttggaacggttattaaaaatcgacgctgcaaccgtacgtcgtgatttttcttattttggtcaaatggggcgacgtggatatggatatgatgtgaagattttattggaattatttaacgacgttttaaaacaagatacagctgctaatgttgccattgttggtgtaggtaatttggggcatgcgttaattaacttcaagtttcataagacgggcaatgctcggattaaaatggcatttgacgttaatcctgaggtagtaggtacgattcaaagcgaagttccggtctacgatattaatgaaatcaagcaacgtgttagagatgagaagattgaagtagccattttaacagtgcctaattcacaagcacaacgggttaccgatttacttgtagaagcaggcatcaaaggaattatgaatttcaccactgaaattattgatgtaccttataatgtaactatccatgatgttgatttatctctagaattacaagccttgatttactcaatggatcaagattaaaaaatacaaaaagctatgactcaatttctaaacgacggataagtcgcttattaagtcatagcctttttattttagtttataaaatatgaatttgattttcttcacattgatcaatcatcgattgaggccagacactagcttgaacttcaccaacatgggctttacctaatagcaacatgcaaagacgtgattgaccaattccaccgccaatggtgtagggcagttgatgattcaacaacatttgatgataagggagatggattcgatcctctgcgttagctatttttagttgttttagcatcgactcttcactaactctgattcccatgctagaaatttcaagggctttttgaagaggttcataccaaaataaaatatcgccgtttaattgccaatcatcgtaatctggtgcgcgtccatcatgacgttcaccactttttagcgtcccaccaatttgcattaagaaaacgcaacccagttctttacagatggcgtcctcgcgttctttaggagttaatttcggaaaacgatcctctaattcttgggtagtgacaaaatgaatttgatcaggaagatgatagacggcttcaggatatttataccaaacttcgtgctccatgtgtttgattactttaaaaattgtttgaactgtttctttaagggtagttagattacgctcactttgatcgataactttttcccagtcccattgatcaacatagatggaatgaatattatcaagatcttcgtctttacgaatggcattcatattagtataaagtccactgtgcatctcgaaatcaaagcgtttcaaagcaactcttttccatttagctagagagtggacgatttcgatgctggtttcaggcatatcttgcatagagaaggaaactggggtttcaactccatttaaattatcgtttaacccagtggcactaggaacgaacattggtgcagagagacgtgagaggttgagttcttttccaaattcatcttgaaaagtttcgcggatgtagcgaatggcctcttgggtttgacgtactgataattttggatcgtatgatgcaggaataattaaatccataattgattctcctttaataaattagattttaaggataaaagaaaaagcctttcatccatgacaagggacgaaagactttccgcggtaccacccaagttgcctatatttaataagccacctcaataagagtacaaacatactcctccgattggtaacgtaccggtcacgtctaagcctactttagcctatgctatttcagttagaaactaagaaagtgttattcaaaagtatcagggtctgattgggtttccacttatcccaactcactgacagaatgataaattctactcgtctctctttttgtcttcattgatttttaatttgattatcatattatcataagaaactgaagttgtaaaacataaatttgttgacagataaataaaaaagcgtattttaaaaaataaaactaggtggaaagtatgataacttcagatgcattgttagtgattgatttacaaaatggagtatgcagaggtagaacagatattgatcatttagaaaaattaattttacaagtaaaccaattaattcagtgttatcgagaaaaggaaaaagagattatttttattcagcacaacgaggttggattagtgtgtggctctactaattggaaaattcttcctgaaataaataacaaaataacagacatttatgtagataaaacccatgctaactctttttatctcactaatttagaaaaaattttaaaaagcaaaaacattcattcaatcgagatttgtggggctcaaacgcaatattgtattgatagtacagttaaaatggcgcatggactaggctataacttacaaatgcagaaaaatggtacaacaacttatgataatgaatttatgacggctaaggatacaatcgatttttatgaagatatttggaaagatcgctttttaaaactatattaatttccaaaaagctttgatgtagctaaatactgcattaaggctttttttattaatttccgagcttttaattaacgtatcgaactgtttattttttaaaaacgaactttttattaaaaattaaaataaaaagttcgtaaaatatcttgataaaactaattttacttgttacactgaacttgaaatttgatacagcatttaaatttggaagggaattgtcatgagaaaagtcgcagtagttatgggttcaatttctgattggtcaaccatgaaactggccacagacatacttgatgaatttgaagtcgattatgatcgtcatattatttcagcacatcggatgccgaaagtattacagaagtttggtgaacaagcacaagaaaatggatatgccgtgctgattgcaggagctggcggagcagctcatttaccgggaatgttagcagccaacacaatttcacctgtaattggggttcctattgaaagtcatgcattacacggaatggattcattactatcaattgtccaaatgcctagtggagtccccgttgcgactatggctattgggagtgcaggtgctaaaaatgctgctttattagcagctgaaattttagcgttaaccgataataaagttgctgaaaaattaattgaattccgtcaaaaacagactcaggaggctattgagagtgaaaagcaattctgaaaaagggattattttaccgccggcaacaattgggattattggtggtggacagttaggtcaaatgatggcgttagcggctaaagctatgggatataaggtgggggttctagatcctacgcgagattgcccaaccagccaagtttgtgattttcagattgtagccgaatatactgaccatcacgccttaatgcaaatggcggagcggagcgatgttttaacttatgaatttgagaatgttgatttagctagtttgaaagtagcacaagaattggtaaccattccgcaaggaaccaacttactagctattactggagaccgaatccgagaaaaaaattttttgagcagtcatggaattccggttaccccctatcaagttgttgaaaagcctactgatttagaagtggcaattgctaaattagattatccaagcattttgaaaactagtaaaggaggttacgacggacatggacaacaagatattaattccgaagcggatttgcttgctggacaacgtttagtagcccaagctccatgtatattggaacaacgtcaaaattttactaaagaattatctgtcatggtaacgcgcagccgtgaaggaatcattcaatgttttccagtagctgagaatgaacatcagcaccacattctacatcaaagtattataccagcccgggtttctcaaaacgtacaagacaatgcccgaaaaattgctcaaaaaattgctcagggattagaactaaggggcgttttaggaatcgaattttttatgttagaaaatggccaattattggttaatgaaatggcaccaaggccacataattcgggacattattccaccgaagcatgtaatatttcgcagttcgaagcccacattcggagcatttgtggattggctttaccaaaagtcacacaaactacaccagcggtgatggtaaatctcctcgggcagcaccttgaagttgctcgtcagaagttagttcaaagacccgattggcattttcatgactatgggaaagccgaaagtcgagtgaatcgaaaaatgggacacatcacaatattaggtgatattcaaaaaagcttagattcaattaaatcagaaaatatttgggagataaaataatgaagaagaccacgttgattaaagaaggcaaagcaaaaagactttacaatacagatgaaaaggatttggtgtgggttgaatatatggatcaagcaactgccctaaatggaaaacgtaaagatcacattgctggtaaaggtgaattgaataaccaaatcgattgtattttattcgagcaattagttgcaaaagggattcacacggactttgtccaacagctttcaaacaacgaacaattgaatcgtaaagtaaaaattattccactagaggtagtcgtgcgtaatgcggcatcaggcagtttccaacgtaagtttgatgttccgtatttacaagcatttgaccagcctgttgtggaatttttttataaatctgatgaattagatgacccatttattaatactaatcaagcaattgcgttgaaaatcattgacttagaagagagtcaacgattggaaaagatggcgttacaaattaatcaaattttaaaagaacgctttgctaaagcccatttgcaactggttgattttaaggttgaatttggtaaaaccgcagatgacgaaattgtattagcagatgaaatatcaccagactcatgtcgcttggttgatttaacaactaaagaatcacttgataaagatgtttttcgtaaaaaaactggagatttagtgaccgtctatcaggaagttttaaatcgcttgaataattcacaggaggaagttcatgtataacgccaaaatttacgttacttacaaagaatcgatcttagatccccaaggagaagcaattaaaacagcgttacatcgattaaactacgaaaatgttaaagctgtaactgtcggaaaatattttgagataaaaattgaagatcatggtcaaaatattgaagagcaagttagaaaaatgagtgatgagctactagcaaacattaacatggaaacttatcgatttgagattagcaggattgaggaggactagcaatgatttacagcattattcgttttccagggtctaattgtgattgggatatgtactatgttttgcgcgacgttatgaacgttgagcctcaatttgtggactatcgcgaaaaatccttaccgcaagatacagttgcagtcttaattccaggcggtttttcatatggtgactacttacgaagcggcgcaatcgcacgtttttctcccatcatggatgctgtaaaaaaatttgcctatgcgggaaacccagtaattggaatttgtaacggatttcaaattttaaccgaagccgggctgcttccgggggccttgcgatcgaatgatagtttgaattttatttgtaaaccacaaaacttagtggttgaaaataatcagactatctttactaaacgttttgatttaaaacagaccgtaatgtttcccattgctcatggtgagggtaactattattgtgattcggctactttacaaaccttaaaggatcatcatcaaattgtcttacgttatcaaaataatcccaacggaagtacagacgatattgcgggaattatcaatcagaaaggcaatgtgctagggatgatgcctcatcctgaacgcgctagtgaagctgtcctaggcggcgaagatggcaaaatgctgttccaaagtttagttgaaaacatgacgcaaaatgtttaattaaaggagttttcgcaatgatgaaggaattgacacctaccgaaattcgagatcaaaaattgtatttacaatgggggataagcgaagacgaatatcagaaaattaatgatgctttaggtcgcctacctaattttacagaaacaggtttgttcgctgcgatgtggagcgagcattgtgcatataaaaattctaaacccctcttaaaacaatttccaacaacgggttcacagattttacaagggcccggggaaggagctggaattgttgatattggtaacaatcaagcggtggtctttaaagcagaaagtcataatcaccctacggcagtcgagccttatcaaggagcggctactggagttggaggaattattcgtgatattttttccatgggagcgcgtccgcttgcattaatggacagtttacatttcggtgaattgaatgatgcccatactaagtatcttgttgaccagacaatagctggaatcggcgattacggtaattgtatgggaatacctacagtaggaggagaaacgaccttcgatgcaatttatcaaaacaatccagtcatgaacgcaatgtgtgtggggttattggatatcaacgaccaacaaaaaggagcggctgctggtgtaggtaatgccatttactacgtgggggccaaaacgggacgtgatggaattcaaggagccatttttgcttcaaccgaatttagtgacgaacaagaaacgcaacgttcagccgtccaggttggagatccttttgctgaaaaacaactaatggaagcgtgcctagaactgattcataaccattccgaatatctagtgggaattcaagatatgggagcagcggggttgatttcatcatctgcagaaatggctgctaaagctggatatggaatgcatttgaatttggacttagttccacaacgtgaagaagaaatgatcccttatgaattaatgctatctgaatctcaggaacggatgctgctctgcgtcaaacaaggatttgaacccgcagttgaagcactatttgctaaatacgagagcgaagcagtaaaaattggtgaagttactgccggtgaccgctatcaattaacctttaagggcgctcaagttgctgatgtaccagtgcatgctttggtggatgaagccccagtttaccatcaaccaagtcagaaacctcagcatatcagtgaaactaaaaagcaacagtatcaacctaaaattgaaaatttaactaaaaccttccaagcgatgttgcaacaacccacaattgcgcataaaggtgctatttttgaacggtatgactctcaagttcaaactaatacaatttcaacgacacaaagtgatgcggcagtggttcgtattcgaggaactcaaaaaactttggcgatgacgaccgatgctaatccgcgttatttgtatttagacccctattatggtggacaaatcgcggtcagtgaggccgctcgaaacatagttgctacaggtggaataccattggcaattaccgactgtttgaactttggtagccccgaagacccagaaagtttctatgaattagaacaggctactaaagggatgacggaggcttgtaaattatttgatacacccgtcatttcaggtaatgtctcactttataatgaatccaaccaacaacccatttatccaacaccaatggttggaatggttggcttaattgaaaatccagcttggataacaaccatagattttaaaaaatctggtgatttaatttatattttgggagaaacaacagcagaacttaatggtagtgaattacaaaaaatgcaactcggacatgttgaaggtccattatttaatttcgatttacgctatgaacaggagcaacaagaattgttgactcagttaattcacgcggaacttttgaatagtgcgcatgacttagccgaaggtggcttagccgttggtttagctgaatgcgcgttcgctagtgagttaggatgtaacgtcaagactaatttaacagctacagaactatttgccgaaaatcaggcccgctttattgtgacgattgctccagataaacaaaagatttttgaagcacaagtggcaaacagagcaactttaatcggccaagttgacggtaagcggatcaaaattgcaacgatggatgatgtaattgatgttgatttgaaaaatactaaggagagttggaagggagccctagcatggcagctgaattaaagggtctaaacgaagaatgcggtgtttttggtatttggaatgattcagaagctgcccaacggacctacttcggacttcacagcttacaacatcgaggccaagaaggtgctggcattgtcgttcgtaatcaagaaggacagttgaaaattcataaaggaaaggggcttttggcagatgtatttagatgtcccgatgatttggcacagctaattgggccgagtgcgattggtcatgtgcgctatggaacagctggaaaccgaggaattgaaaatatccaaccgttacttttccactacttacagggagatgtggcgatggcccataatggtaatttaaccaatgcagttagtttacgacgcgaattagaaaaaagtggggctacttttcaatctaattctgatacggaagtactaatgcatttaattcagcatcaaaaaggtccaacttttgttgaaaaattaaaagcgagtttaaaacaaattcaaggtggatttgcctacttaatccttaccaaagatgcactgtacgcggctcttgatccgaatggttttcggcccttagtaattggaaaattagctaacggttcatatgttgtagctagtgaaacctgtgctttagatgcagtcggagcaaccttggttcgaaatgttgaaccgggacagttagttcaaattgatcaccttgggcttcagattagtaattttactactaaaacccagttatcaatttgttcgatggaatacgtttattttgcacgacccgattcagatctttatggcgttaatgttcatctcgctcgtcaacggatgggtcaacgattggcaaaagaaaaccccattaaggtcgatatggtggtgggggtgccgaactcttcgttatcagcagcatctggagtggccgaacaactaggcgttcccaatgaaatgggattaattaaaaatcaatatagtagtaggacttttattcaaccgacccaagcactacgtgaacagggagtgaagatgaaattatctgcattaaaagcagtaattgcggggaaagatgtggcattagttgacgattcaatcgtgcggggtaccaccagtcagtatattgtgaaaatgttaaaaaatgcaggagctaagtcggtgcatttgatgataagttctccaccacttaaatatccatgtttttatggaattgatattgaacatacacgtgaattgatggctgctaattatacggtaagtgagatgtgtcagaaaattggagcagattcactgcattttttgagcctgccaggtttaattgaggcgattggtttacatcaagatgcacccaatgatggcttatgtgtagcgtattttgatggtaaatatcccacccccctttatgattatgaaaaagattttgagatccctaaaacagctaacgattttacattatcagcgatggcccaagtggaggaaaaataatggtagaaagtgcttatgaaaaagcaggtgtgaatattgcagctggtgaagaacttgtagctgatctaaagcaaaaattagatactccagaccctcatgctctaggcggacttggcagttttgctggatgttaccagttatcaaaagatcaattggatcagccggttttagtagcgggaagtgatggagtgggaaccaaagtgcttttagcggcccagtcaggtcaagttgaaacgattgggcaagatttggttgccatgtgtgtaaatgacttattggcgcaaggggcgttgccattattctttttagattatttagcactatcacatttagagaaaaatcaggttaaaaagattttaaacggaattttaaaagcctgccaggctcagtcaatcaccctgttaggcggagagacggccgaaatgcctggaatttatcagaaacatcattttgatttagcgggttttgctgtgggactaactgctaaacgtgatttactccaagcaaaaaatgtccacaatggagattatttaattggtcttccctccagtgggttacatagtaatggttattcgttagttcgtaaaattttatttgaagaccatgatttccagttcgatgatcagttggcaggattaaatggtagtttgattgaagaattgatgcaacctacccgtctttacgtcaacgtgatttggccacttttaaaacaaaaattggtcagcggaatcgctcatattaccggtggaggattattagataacgttccgcgaatgttacaagatcagcaacaggctgaatttaagttggatagttgggaaaagccggcaatttttaaaatcctagcggaacttggaaagctatcccagacagattgttatgaaacttttaacatggggatcggaatggtactagctgttagccccaacaattatgccagagtggtagcagaacttgaacaacagaaagaaacatattttaagattggtaaagtgaaaaaacgggagaaagatgcaccagtggtttatctttcgggagggagcagatgattaatattgcagtttttgcatcaggaacagggactaattttatggcattacaccaacatattcgagaaacaaaagttcccattaaaattgcatgcttaatttgtgatcaacccaatgcaccggttgttactaaagctgatgaattaggaattccagtctggacccatcatttgagagaatttgaagataaagtgagctatgaaaaggcgattttacgtgagctaaaaaaatataatttagcattaatcattttagctgggtacatgaagattgttaccaaagttttgttagaggcttatccacatgccattcttaatatccatccagcactgttaccatcgtttccagggcgccatggaattgaggatgcgtttgaatatggagtaaaaattactggagtaacgattcactggattgacggagggattgatactggcccgattattgctcagcaacctgtaccgattttacaaggggatgatgcggagcatttagctcaacgtattcatcaagttgaacatgatttatattttaaaagcatctgccaagtattaaaacagagaaagttgattaactaaggagagattaacccatgaaaactgcattactaagtgtgtcagataaaactggaatcgttgaatttgctagaggtttagttaaggcagattttagaatcgtatcaacgggtggaactaaaaaagttttggaagaggctggattatctattgttagtgttgaagctattactaactttccagaaatgttggacggacgagttaagacgctacatcctgccattcacggaggattgttagcgcgccgtgacttaccgaaacatttggcagccctcaaagaacataatattgatttgattgatctagtttgtgttaatctttatccgtttaaatcgactattatgcaaaatggagtgacggaagcagaagcaattgaacaaattgatattggcggtcctagtatgttacgctcagcggctaaaaattttgcatcagttttacccgtagttgatcctaaagattatcaaccagttttagctgcactagcccatcagacggacgatgttaaatttcggcgagcgttagctttgaaggtctttcagcatactgctgcttatgacactttgattgctcaatatcttggacaaaacggtgaaattttcccagatgaacttaccaagacttatactaaaaaacaagtaatgcgttatggcgaaaatagtcatcaaaaagcagccttttatgaagatgcgctacctgtaccattttcgattgctcaagctcaacaattgcacggcaaagcattgtcatacaataacattaaggatgctgatgccgctttaaaaatgagcgccgaatttaatcaaccagccgtggttgcggttaagcatatgaatccatgtgggattggattaggtcaaaatattgaagaagcttgggaccgcgcttatgaagcagactcgatgtcaatttttggtgggattatcgtcttaaatcgaccagtagatttagcgacagcagaaaaaatgcataaactttttcttgaaattattattgcacctagttttgaaaaggaggcttttacagttttagctcaaaaaaagaacttacggattatgacggtcgattttaatcaacatcaggatgctaaagaacttgaaacagtttcagtaatgggcggactcttggttcaagaacaggatacggtagttgaagtggcgactgacttcaaagtggtttctaaacgtcagccaacggaaagtgaacttaaggcaatggtatttggtcaaactgttgttaaacacgttaaaagtaatgcgattgtgattacaactgatcaacaaaccttggggattggtgcaggccaaatgaatcgaattggttcggttgaaattgcggttaaacaggctgaaggttcagctaattttaaaaatgcggtaatggcttcggatgcatttttccctatggaagattgtgttgaatatgctgctaaacatggaattaaagctatcgttgaacctggtggaagtatcaaagatcaagcttcaattgataaggcggatgagttaggaatttcattaatatttagtggacgtcgtcactttagacattaagcggaggtaccagatggcaaaagtacttgtggttggaaatggtgcaagggagcacgttcttggacgtcagctattgaaaagtaatcaagtagaaaaagtttactgtgcacccggaaatccagggatgttggaaagtggcattgaaattattcctattggcgtcacagattttgggaaattagttgagttcgcccggaaacaaggtattgatttgacggttgtcggaccagaacaacctctacagcaaggaattgtagattattttagtactgcggggttaacgatttttggaccgactcaagcagccgctaaactagaaagttctaaagaatttgctaaaaagattatgcaagaagcgggggtccccacggctagttatgttagctatcaagatgaagctaccgcaatcaaagggctagcaaaaaaaaattatccactggtaattaaatcggatggcttagcggctggaaaaggggtcgttattgctaaaagtcagaaggaagctacgacaacgattcataaaatgttgggtgaacatcaatttgatactaagtctattattatcgaagaatttttaacgggacaggaattttccttgatggcttttattcaagacgaacaaattattcccatgcctctatcgcaagatcacaaggcagcttatgatggtgacgaaggccccaatacaggtgggatgggagcgtatagtcccttgcagcattttccaagtgatttggttaatgaaggtgtggaaaaaattattcgtcctattattcgaacacttaaaaagaagaatattactttttgtgggattctatacgctggtctgataatgacagactccggtcctaaagtgattgaatttaatgtacggttgggtgatcctgaaacggtggtagtattaccgcagctacaaagtgatttatacgaaatgttgcagggattgctccaccaccaagtgccagtggttaaatggcaaaaagaccaggtttacttaggagtagtaattagttcgcaaacttatccgcaagcttcggcaaggggagttgaactagcagattttaattaccttccatccaatattacagttaattatgcgggcgttagttgcaatcgagacggccaattaattagtaatgggggacgaatcctatgtttgaccactggagcgagcaatattacgaaagctcaagcaatattgtacggatggttaaatcagcacccaattctgggcttacgttatcgaagtgatattggagataaagcaaaataaaaaataaccatggaagaacgatgacggcgacttaaaataattcgattccatggtttttttaactaaaaaattagtaacatttaatactatataaagtgtaaaacgttttaagtaagtgctataattaatcgtaagtgtggtatagatatagtaaagaagtaacgagataatgtttacttgtcattgagtaatttcccaaacaaactgaacagggtttgaagtcgtaaatatggatattatgctagttatacttgataaattaagaacgatcggtatatcagaagattggattcagatggtttggaagattaggacgatgacagagtaaagcaagattatttgatgaacattttaagtaatcggtttagtcatgattttaatgagcactaacttaagaaatgtggtttgtatacttcttttatgaaatttaatcgatacatcatttattggtttaatggaaattttgatagtgaaattacgacggatgagttaattaacttgtccgttttgtgagtagtatgttatctaaatatttttaatgtaagatatccaaataatgtatgaacttagagtacccagtaatattcagcttttaaaaaaagaagaaataaatttaatgttttgagagaagttataaaaatggttgttcaacatgatgaaatcaaaaaattattaaagggtaataacttagatagcactaacgaatggattgtctatggtaccaaaggtgaaaggggatattggattgcgttgagtgatcggggggttaccctgttgcctgttgctcagcaaggaaatctaactggggaaattatccccttcgataatcaaaaaattaaaagtattgccttaaaaaagagcattctatcgaataagctcataattgtggatactaaaaataaaaaacatgttctaaaagtagctactcgccatctgggaaataaacatcatcatgaagactttttaaaaattattgaaaaatataaaaaataaaaaaaacgattttaagtgtcgatgaggacattaactgttatcttagaatttttgtctcaattcggaagatatcatagttacttaaaatcgtttttttattttaatcatttaagttatagcgtaatttcatgtgagctgatcctaatgttaccatgtcaccaagtaatttagtttgacgggtaaaggattctgtagctagttgttcattagcttgttcaagaaattgagttgggttagtttggtgcttgattgcccgatcagtttcattttgaattcgacgataaataccagtggtttcaagttcgaaggtgttccgaagatcaacgtataagtcgtaatctgtatcacctaaaagagcggtagtacagctcagccaatacatgttgttcatatcaaatgtaccagttgcattcttatagacagctggtgtgtcggtgacatgagcgtaaaaaggaactaccgtgttgaacgtgttggctccgtatgcaagccagtgaatgccggcaatttctgctggaacatggtttcggatttgaaggatgtggacattatgattccgattgataccgattggacgaaagagggtcttttggtcctcagtaccgttaccatatggatcaaattccgtattttcaaagtgggagctcaaaacaaacttaacgtcttcaatagagatctttttgttagcatgacagataaaaggtaaatcttgctccatgggatcattttcaatctcagggttgaagtatttttggccataccaagtacggggattattgtaaacagtatctttaatagaagcactaccaaagatatgacggaaattataaccgtcaaaatcaggatttaagtgatattcatcaattaaatcttttaaatcagctgagcatagcgtgtcatcagattcaaaatcaaattgatcaatattcatacggttaggtgccacaacgtaggcgtcatctggtatacgaacggcagcccaatgatggccaccaatcgtctccaaccaccaaacttcttcgttatcagaaaaagcgataccattaggttcatatgttccaaatttttctaaaagagcgcctaagcgtttaacaccttcacgtgcgctgtgaatatatggaaggacgagagtaacaatgtcttcttcaccaattccattctctacgaaggggtccatacctaagacgcgtgaattagtagtgattgtctcggttgcagacatggcaatattttcactattaatccccgctgcgggccagattccgttagttaaaatggaatttggcattgatgtgtaactcaaaggctgatcaggaagcttgattttaacaccactgataacggcttggtaatcacgtggttgttcctcggggttaacgaccacgaaacgttgaggatcaagagcttcatgaccatcatcattacgggaaataatcgttgaaccatcaatagaagcatctttaccgaccaaaatggtcgtgcaagaacctttaattttcttattcatagattaaaaacctcctaaaaatttgttattttctattatagcgcttttaaattgtttttggtaacgaacaataaaacgttttaaaaataataatgttcgtatttttgttttaatgaaaaggttaatgtgctaaaatgttcgttgtagctatcttaataattacgtggagttggaggaaatatggaagatatacaaaaacaaggtgccaaaaatgttgaactatcaacatcaaagacgattttattagcttttcagcatttactggcaatgtatgccggggatatattggttccattattaattggggcggcgcttaagtttaatgcgcaacagatgacctatttaatctcagtagatattttcatgtgtggagttgccacttttttacaggttaaacgcactccactaactgggattgctttaccagttgttttaggatcagcagttgaatacttggcaccgatggagcacattggtaatacaatgggctgggggtatatgtatggtggagtaattgcagccggaatttttgtgtttttaattagcggattatttgctagtttaagaaaattttttccaatcgttgtgacgggctctttgattactttaattgggtttaccttaatccccgttgctttccagaacattggtggtggaaacgttgctgataaaaactttggaagttcttctaacttaattttaggatttttaacagctttagttattattttaattcaagtttttgcgcacggattcatcaaacgcatttcagttttgatcggaattatcgttggctcagtgatagcagtggtaatgggactaatcgatcctacaccaatcagccaagctcactggattcaaattccaatgcctttttattttgcaactcctaaatttgaatggtcctcaattttaaccatgctcttggcagcagtaacttgtatgattgaatcaacgggagtttactttgctttagcagatattaccaaacggaatctgacagccgatgatttaaaacgaggatatcgttcagaaggaattgcagccattttaggcgggatattcaataccttcccatattcaactttttcacagaatgtgggaattgtgcaattatctggaattaagaaattaaaaccaatttatttctctgctggaatgcttttgattttaggattgattcctaagtttagcgcgattgctacattaatcccgacatctgtattaggtggagcaatgttagtaatgtttgggatggtaggtgcccaaggaattaaaatgctagctaacgttaaaatgaccgttaataatttattggtaattgctgtatcgattggaattggtttaggtgtaactactcaaccaacgctcttccacattttaccaacctcagttcaaacaattttagataatgggatggtagtaggctgtatcacagcaattattatgaatattctattgaacggtaaccaagccgttgatggagaatagtttaatttaaaatatataattaaaaacaagagatgatactatttggtatggtctcttgttttattttctgagtataatggaagaaaaacgatggagcgggtctcatgaagttaaatgtcgagttgaaggaacattggactaacattatttcaaaagaagatgcaatcgaaattaagatttacgatggaactaaaccaccagttgttaaccattctggtattggaattttattatttaagggaaaagttaaaaatatttttcaagtagaaaaagagttaaaagtgaagggagatcgttgggatcgattaattttaatatctattcctgctaacttaaaactccatcatgtgttacaagggttcattcatgaggcaataaaaaataaagtgactttgccaaaacatttaaagaaagaaaagcttcccccagcagttcaagagttagtagatcggtttgttcaacaacagctttttatcattaatcgatttggctcggatcatgttttaatttcagaaaagtcaaaactaggagggaaacctagccaccgttggaataaaatggttagtcagattccattttatgtggataccaaagaatgtcaggcagaaattcaatgggtaaagcgaaatgaaatggtaattagggccggagcggtaatgaaacgcgaggttccattgaataaaaatggttcaattggatttgctgctaaaatgggacagaaaatccgagaagatcatcaacaatcttttaaagattctaaaaccacagaagatataatattaaaaagtgtcaacgaagtggggttgtttctgtattttgcgggaactaatagctggttagtcctgaaagatgctaaagggcaaacgattgacgcatggacacgggtgaactaaaaaagagctgtaaacgaagtattcgtttacagctctttttatagtttattatttaacttttggtgtttcagcgattgtttcagtcttgcctttagcaaattgttggatagcaacaacgcgttcttgacggcgacgacgttcgcgcttaccagaaactttacgtgcacgtgcaaatgaattgtatggtgacttcatggtgatcctcctcagaaaaaaataatcaattactattctatgatgaatggtagataaaagcaaataaatttattaaatggattggcggttcgcattgaatcgctggaccgttcgcattgcaattttaccaaaaatacgaattaaaattacttggattggcaattgaataatattactaatgatgcgagctgagttgtaataaacggccgctgctgcaccaaagtaaatggattgccaaatgaaatttaagcccatcgtaacaattagcatcactaagaggcgtgccacaataatccgccaccagtcgaatttacctgggtataggaatatcgattggattaaattagcaaccatagcactgatggcccaaatgggtaagtaaggtcccaccggattagaaaaataccccacggtatcactaactaatccaaagacaattcctgcccaaggtccaaatagcgcagacacaacggctgctggtatatattcgaaactaaccaaggtaaattgaggcgtcaaatggatggtggtataacgcgctaacacaacatccaatgctgccaacaaagccataatggttagatttcgcacagaaaaaacatttttgatactaaaaaaattcttcatgcaaatccctccagtctttagttggccgttttaacgaaaaggaaatagcatgaaaaacttcccaattcaacggcgagatgcggaatcgatatcgctgacaagcattcgtccaacaagcaactctccgtcttgttggcacttaacgcatcgattcctactccattgatagagctaagttcattataaccaacttaaaataaaaataaagagaatgaattcgttaattaatatgaaaaatcgtatataatggctttaatgatgtaataattatgccagatgaatgggagtacgtatgcgataccaatttaaaaataacttagaagaaattattagtgccaaaaaagtattacaaagatcagggatgagccagagattattgcaaagaatccaaaatgagggtcgcctgattgatgaaaacgaaaacgatgtagaatttagtgataaattaatgccttttgaaccaatttggattgaattgcctgatgaagaacaagatcaaaatgttgcaattagtgatggtccattagacattatttttgaagataaaaattggttattagttaataagcctgctggactaaccgcggtccctggtccaagtgatcgagaagatacattggtcaaccggattaaaggtcattggcaggccattgaatctaaaaatatgatgcctcatttagttacccgtttagatcgatttacgagtggaataactttagtcgcccgtcaccaagtttctaacagtttattaagtgaacaagttgcgcatcataaaattaaaaagatttatttagcgatggttgatggagtagttcaagctgaaaaaggaacatttaatcaaccgttagggttagcagccgatggaattcatcgagaagtacgggacgatggacagcaagccactactagttttaaagtgctcaaacgttttgaaaatcaaacgctggttcaagttcacttaaaaacaggaagaacccatcaaatccgagttcattttgcgaatgcaggtcaccctctagttggtgatcagttatacgatggaccaatggatagaggaattaaacggcaagctttgcacgcttcatcgatccgattttttgatccatttattgatgaaaaggttagttttacagcagaattaccagatgatttaaagcaaatcgggatggaagagtagcataattgcagtttcagataggagaacaaaatgacacaagaaaatgaatttgaagacgtagaaatgacgttaggcgaaccagaatttaatgcgatgttgatgcaaatgacgcatgaggtaaacgctagcaatgcgtcagaatataactttatgggtaatacaacccaagaagttggggaaaatgtatgggcagttccggcttatctaagtgacgaatatgcgctattctttctatatacagaaattgataccggcgattgggtcctagccttttccgaagcagatttaggtgaagggcagtttaatctaggaactccaatgacaacgggtgaaggcttaaacaaattattcgatcaagatcccgatcgtgccaaaatggtattgagttttgttaatgatatggaaaaagctggcgaaggtatgtggcgcatggtggaacaataaaattttacatttaaaaagagcggactatggggagcgaattaacgtaagtttcttctaagaagctctttttttgtaccaactttttgaatatatttttatgatataattaacttcgactaaaaagaaaggggcgacgcgatggcaacgattttgatcgtcgttttgctattggcttccattggagtagggtatggattgcgagccaaaaagcatagtgaaacattagcgcaagcccgcaaagcggcagaaaaaattattgaacatgaacggcaaaaaactaaagccgaagtggctgaatatgaaaaaaatagtgttcaagaaacccaacaatatcaagagaccattgaccaagaactcgcagatgatctacacgataatcaacgtaaagaggcgtggatcgaacaaagaatgaacttattgaaccaaaaaaagattgtgttaactaatcgagcggatgcattagctaaaaaaagacaaagcctattacaagaacgcgacaatgtacggacaactttaggcgaagctaaacaactaattactgatcgatggaataaacttcaggaagttgctgatttggaagagcaagcagcttcaaagttggttttgaaagaaactaaacaagatgcaattcgttctaaagatgagtttgttaacaacgctcaaaccgaattagaaagctcctgtgagcgtgaagctgaggatttgatagccttagctatggaacatagtgatgttccaagaggtcaagccgaaaatcaccgcagttttattgcagaaaatgctgaatatcttggtaaactgattggaaattcaggacagaatgtacgagcaattgaagcattaactggtgtagatattgtgattgacgaccaagaaaaagaggtcattcttaacggttatgacccagttcgtcgagcagtggccatggaaaccatggaaatgattaaaactgagaaacgagttgttccagatacaatcgaacggttggttaataaggctaataaagtaattgaccaacgtattcgccagtatggtgaagacgcggttcgagaattgaaattaaaatatgttgcgccggatttaatcaaatttattggtcgaatgcattaccggacgagttatggacaaaatattttagaacattctattgaaactgctaagctagcaggtatttttgctgttgagttaggtgaagacgctactttagcacgacgtgcgggtttactacatgatatcggtaaatctattgatcgcgatattgaagcgactcatgtggaattgggtgtggaattgaccacccaatatcgagagagtccagtgatagtgaatactattgcttctcaccatggggatgttgaagctcgatatgtaattgctaatttggttgaggcagcggatgccatttctggagctcgtcaaggtgctagaagtgaatcagtggctgactatatccaaagaattaagagcttagaagagattgctaacaaacatccagaagtcaaggaaagttatgctatccaagctggtcgtgaacttcgagtaattgttcaacctaaagagacagatgataagacgattcatagtttagctactaacgtaaagaatcaaattgaagaggatgttacttatcctggtcaggtgaaggtaacggttgttagaaagttagagattgtagaatacgtggagaaaaaacaagcatgagtgaagacaacaccgcacagttagaaaaaatcgatagttttgttaaagagaagcttcaagatgacttaaccgggcatgattatgctcatattcaacgagtggttaagatggctaaacgcttaattgatgatcgcactgaaaatgtaaatcagtttgtagttttcgctgcagggtatttgcatgacgtgattgatgaaaaattagttgagaatcaggccgttgctgaaaatgaagtagctcggtttctaagaagccttggagttagcgattttgatattgctcatattttcgatattatcacgcatatgtcattttctgataatttaggacagaaatataaattatccttggagggacagattgtccaagatgcggatcgtttggatgccatcggagcaattggcattgcccgtacattttattacgggggtgcacatggacatattttatatgatcccgaaatacaacctcgtgaaaaaatgacgcatgatgaatatcgtgacaataaaacggtaatcaatcatttttacgaaaaactttttaagcttaaagatgacatgaacacacctttagcacaaaaaattgcggtagaacggacggagtatatgaaaagcttcgtaaatgagtttaaaaaagaatggtaacagtgaatttagggggatttaggaatgttaaaagatactgataatatacccagagggtatgtgattgtatccgcagtcgttgttgttttacttgcactaggtgttaagttacaaaacacatttatgcaattttttgaccagttatttagtagtatcgttcaaggaacggctttttcttttcttgaaccaatcatgcgcttaattacgatgattgcagataccaagcttggtttaatttatgcaatcattattgcagtatatttgtggtttaaagaacagcaacgagtagatgctatctgggtcatttgtacaatgtttggtggcgctgtagtagcgtttattctaaaagaattggttaagcgtccgcgcccaactattgatcaaattattccagaaacaggttttagtatgcctagtgggcacacctttgaagcatttttagtgttagcttttatttacctttattttgtccgtccaattcagtctgatagtaagcggcgttgggcttttcgaggattgattctatggcaagtcttagtaatgtggtcacgaatttatatgggggctcattaccttactgatacggttacggcggtagctttaggcatagtgtggctatgggttgctttatggctttaccagatgctatatgattggattgccagctttgttgctccttcagggggacgacatcaacgacaacattaaaatattttacttaagggcctaatcttttaggttctttttttctgattatttcctgattgaaccggtccaaaacggcttttttggtaaagcggtttctaaaaaataatttgttttttggaagaaaaaccttttaattattaatctatcaatgttttagcgacctaaaacaaaatattaaagaaggtatctttttttttttgagcatgctataatgagcttgtgcttttggttaggtgcttttggtcagatcgtttcattttgaactatccccattactaccggctcaagctacaaattaaacaatgccgtctattactatatagattaggtttacaggaggatgttcataatggaacaaggtacagttaaatggtttaacgctgataaaggttttggttttattactcgcgaagatggtagtgacgtattcgttcacttctcagctatccaaggtgacggattcaagactcttgaagaaggccaagcagtttctttcgacgttgaagaaagcgaccgtggaccacaagcagttaacgtaaacaaaaactaatttaaattaaaatagttatgagagtagggagcttcggcaacctactctttttttatgcaaaacataaagatttagttaaatactattaattaattaggtataatgaattaattgaagaggaggccttgaagaatgattgaaactaaccaaatcgttattaatacttgcttactcgcaggtcgaattatgattgaaaatggctctgagatgtcacgagcagaagatacaatgaaaagaattgcgatgaattcaggtgttaataatttaaaaattttcgggacgattactggaattattgtttcaattccaaattcaatggactctcaggtggaagggattaatcggcgagcgattgacctagagaaagtttctgcggttaatactttttcaagacgctatgcggccaaagatattacgttagaagagttttacgaaaaactaaatactttggatgaggcgacgccatccttcccattttggcttcaagtgattggagcagccctagttagtggacctttaatgacagccttttctggaaatatggttgatttaggaattactactttgactggggcgttaggctatacgctattttattttgtaaatcggattttaaatattaaatatattagcgaattttttgcatcaattataatcggaattatagctgtattcgcagtgcgttggggatggggacattctatcgatgatattattattggatcagtgatgccgttagtaccgggggtgccactaactaatgctgttcgcgatattttaaatggtcacttggttagtggtccggctcgtggaattgaagctttattatcagcatgtgcaattggttttgggattgccttcgtatttcgttttttgtaaacaaaggagtaagagatgcaattactactagaattttttatggccggcattgccaccatcggcttcggaattattattaatatacctaaacgggctttaattgctgcaggtgccattggtggcgtgtcatggacgatttactgggcgatgctccaagtgcgcttaggcttagcgttaagtgctttaacagcgaccactgtcattgctttattaagtttatacgctgctaggcgaatgaaacttccgatgattatttttaatattcctggaattgtaccgctcgttccaggaggacaagcataccaaatgattcgaaactttgcgctttctaacagtgatatggcaacgcattttatgttagaagtaggagaaattgcagggtcgattggaatcggttttttaatggcagaatttatcgatcggttgcaacgtaaaattataattactttgaaggaacacaaacaacgtagcaaaagtaaaagtgctaataatactgaaaaagagtaggattaaaaaatgcccaaattaatttgggcattttttttatttctttttgaaagcgaatacaaaagttgcttgactttcattttatagagcgatttactagtagaaagagacatctaagttaacgaaattttagccatggtgacttgaaaaatttgagttataggagtgaaagtaaatgttattaggtagtattgaagctggtggaaccaagtttgtgtgcgcagttgggaacgaagattatcaggtgaaagatcaaattcaaattccaacaacgaccccggaagagacattgtcggccgttgtaaaatattttaaacaatttgatatagcagctttaagtattgcttcatttggtccgattgaaattcgaaaaacgtcgcctaagtatggatttattactacaactcctaaaccgggatggaaagatactgattttttgggttacatgaaaaaagaaattaatgttcccatggcttggacaaccgacgttaatgggtcggcctatggggagtatacaatgtcaacgctatttaacgaaaaaattaattcattagtttattatacgattggaacaggagttggtgcaggtgtggttatcgatgggcatttgattggtgggattggccatccagaaatgggacatgtccctttgaaacgtcgtcccgaagatcttgattttaagggtgtttgtccttatcatggtgattgcttagagggattggttgctggaccaacttttgaagcgcgattaggtaaaaagggtaaggatgtgcctttgacggataagacatgggatattttagcttattatattgctcaagcagctgtacaaagtacattaatattacgaccaaacaagattgtgtttggtggtggagttactaatgcaaccctcttagagaaagtgcgaaaagaatttgataaattacttaatggctatgtgactgtgccagatttggatcaatatatcacgatgcctcaagttaaaaataatgggtcagcgaatgtcggtaattttgcattggcagagaagctattaacggaataattataaaaagggcaatcccgatttaaaatcaggattgccctttgttctttaattaaagctttattgtccgtagtagttgtagttaccagtagcatttccttgcggatcagcttgtgatggagttgcaggagtgttatcagtggtagctccgttgttatctgcaccgcctgttgtgtcactagccggtgtctccaccgaagatgcgcttgtggttccgtaatcttcagtggaggagctagtagtgtctgaactgttagtatctgaattggtagtatcggtatcatcttcttcgccagtatagatactgcttaatccagttgtcccagtttctttagcagataaatcaagggctttacggatgaaattagtaacacgctgacgttcgctcttagaaactaattcataagaaccaccatcgatggtagtaccattaccttggaggtgagtagactttaaatgatgggtagcaactcgataattagtcgagagtgctaaaagttcattaaatgttaaatcagttttagtttgtttttgaagagaatttaagaaattttggtttaataaagccgtaattgaatcactcttacgtaaaatggccattaaaacttggcgttgacgagtttgacgaccatagtcaccgtttggatcggtataacgcatccgtgaataatccagtgctgccttaccatttagatgaatttttttacctttagtaacgtcggcatgtccatatttgaaggttaatttaggagtgatatcgattccaccaaccccgtcaacaatcttttctaagccacccatgttaattaagccgtaataatcaatgggaatatttagtagtttttcgacagctttgattgctgtaccggctccacctaaatcataagcagcgttaatcttggaaggagaataatttgagtaaccaggaatcgacataaccgtatcccgagggatgctagttaaagtcatttttttctttttaggattcaaggttgccacgataatggtatctgttcggccgcgataattacgcccgagggccccagtatcagtacctaaaagcaaaattgaaattggtttactttgctttaaggtagctgaaacatcacgtgatttttggattttagcactatcaaaaatcgaatctacagcatttttggcatcgtaccatttcttaaccccaaagatagccaatataacagcaataatggaaacgacaatgatggttttttttctacgaggtcgtttctttcgtggttttcggcgctggttttgtttattttgaccgttgtcaccattgttattattgtcatcaggtgtgtaattgaaccggtttctgctgaatcggcttgaattggatctgggtgattcagaattcatgcaacttatcctccgagttatactaaaaaattcaatcattaatatgataccaaattaatggattatctataactttgtttaagaaagtttaacaaatagtacacaaaaaattggtatatcgacattaataacgaacttatttcaattcatgcaaccaatccagcgccgtggttaaccaagtagcaatccgatgatcgacgtgatggttatcataggcggtagtttcatcggctagagccatcccatgagggccatgttggtaaagatgaagttctgttggaacctgcagagcttgaagggctaagaagtaatcaaccgcattttgggatggaactaactgatcatcggccgttgcccaaatgaaggttggggcattgtctttagtggcattttgatcagctgctaattgttgaggatgggtggtccatttagctaaagttttagtgtcaggaaaaccatcattaggagtaattacaggaaaacctaaaatggttgcaaaaggctgcaatgtagttgatgctaaatgggtttgtgaactaagccaggctgcattccagttattattaaaattgctgacgatatgaccgccaaccgagaagcccattaaaataatctgattaacgtcaacctgccatttttcagcgttttgatgcgtaatatccattgcttcggctaattcgattaagggagctggataaagtggctggacttcatcaactaaggagtaccttagaacggagacttggtaaccaaatgattccagacgtaaggcaactttttcagcttgagctaaatcgatgtgggtgtaggatccaccgggcacaaagattaaagatggacttttttgatcagttaaattgggcgatatatatgaaattaattcggcttttgatttagaattagtatgattaagtttagttttaacaatttccataatgttgactcctttttgagaattatatatttggttacattttaatctttttactgttattcaccaaagaaaaggtaaggaactacgaaatgaagtttaaattaagatattttttagaagatgattttagtaattatcaggcgttagctaataatcgaaagattgctaaatcagcggggatgaagattctgacaaacgcgtttgaacaatggatggcgtttaaagggatggttggacgtcaaggctttttagcaatcgtcaacgaagcagaccaagttgtgggcggaatttttatttttcagccagctgcagaagatatatatgaaataggatacttattgggtgaagagtattggaaccaaggtattatgtcaaaagcagtacattttgcaattaaaaacttgaaaaatcgaaataaacgagattttaaagtttttgctaatgtttgtattgacaactacgcctctcagcaagtactaaagcgcaatggttttaagcgtttagaaaagattaccacgggaatctctggttatgatcaatcctcacaaaaagagtatcgctacgaattaaatgtaaaattacttgaataattgaacagatttgttataatttgaatcacatcgaaagaagaggttgcctcaattattagtagatccggctagatgactaagcatcaatgacccgaattgaaaggaaaagaggccgaaatgactacatgcttattcatgtacgatttgggctctggttgaataagccagagactgtcgcaatgaaaattgcggagcgctatctacgatttgactaatgattttaaacagtctttttgtgcgtaggaatgctcacaaaaaggctttttattttgttttttgaaaatcaacagcgcctcttttattttataggaggttttcttatggcagaacaaggtggtagtcaggttaagcgtgccttaaagacgcgacatatttcaatgatttcactgggtggaagtattggtacaggattattcgtagccagtggatcggcaatctccactgcaggtcccggtggtgcattattagcttacgttgggatgggggtcatggtctatttcctcatgactagtttaggagaaatggcgacttatatgccggtttcgggttcgttttcaacgtacgcaactaaatacgttgatccagcctttggctttgcaatgggatggaattactggtttaactgggctattacggttgcagttgatattagtaccattgccttgattatgaaattctggtttccgcacgctccggggtggatctggagcctgttggcactagtgctagttttcttggtaaatgctttgacggttaaagcttttggtgagactgaatattggattgctttaattaagttagtcacggttattatatttttggtcgtaggagttttaaccattgtcggaattatgggaggtaaagccacatatttagaaaactttgtgtatcataaagccccatttgtgggtgggatccctgctattcttagtgttttcgttgtggctggtttctcgtttcaaggtacagaattgattggaattacagctggcgaatctgaaacacctgaaactagtgttccgaaggccattagccaagtattttggcgaattttactattttacatcttagcaatttttgtaattgcttgtatcattccttatacaagccctaatttattaggatcatcagcccgtgatgtttccattagtccatttacccttgtgttccgtcgggcaggactagcaggagcagctggggtaatgaatgcggttattttgacctcagtactatcctcagctaattcggggatgtatgcctcgactagaatgttatattcgctttcgaaacaaggatttgctgccaaaatttttggtaaaacttcgaagcgaggaatcccatacctggccttacttggtacaactatcgtaggattgctaacctttatttccagtattatgggacctaaaatttatatatggttagttgctgccagtggactgactggctttgtggcttgggtcggtattgcgattgctcattggcggttccgtcgggcttttattaaacaaggacatgacgtgtcagaacttagatatcgtgcaaaatggttcccatttggaccactctttgcctttgttctcagtattattgtgattgcgggacaagatattcattccattgctaatttcgattggcaagcaattgggattacgtacatggcaattccgctattcattgtgttgtatacctattataaaattagatataaaacgaagttaataccgctggaagaaatcgatttatcgcgtccagatatcacgaaagaataattttttcaagatattgttttggggtcgtttggtggtacaatatgtagtgctaaaaaacgaaaaaagaggtatttcttataatgattgctttatcaggcccaattggcgcaggaaagacaacacttacagaattattaacaagtcactgggaaagtgatgcttattacgaatcagtagatgataataaaattttgccacttttctacaaagatcctaaacgctatgcgttcttacttcaaatttactttttgaataaacgtatggatagtatcaagcaagctaatagcgatgctcgtagtgttatggaccgttcgatttatgaagattcacttttgttccatttaaacgctgatttaggacgagcaactaatacagaagtggatatttacgattcgttacttaaaaatatgatgcaagagttgccacgtctttcatataagaagaatcccgatttactagttcatattgatatttcgtttgatacaatgttaaaacggatcaaaaagcgcggtcgttcattcgaacaaatcgaaaatgatccatcattatacgaatactatcacgaactcaataagcgctatgttgcttggttcgatgattatgatcaaagtgctaaaattaaaattgacggtgataaatatgattttgtggaaaatccagaagctcgtcaaaaagttattcaactaattgatgaaaagattgccacaatttaattgatatctacccggcttttttgtagaattagtttataaattaatagagaaattaaaggcgtttaaagtaggttttcagagagatccgcatggtggaaaggattagccgaaactccggcgctagttaaaaggtgggtaatgccacacggtgattccgttatcgtcggattgagtgcaccgcttatataagcaggtgaacttgggtggtaccgcgaaaagagtctcttcgtcccaatgtggatagaggctctttttctatatttaaggaggatgtaattatgttagatttgaaaatgattcgtaatcatgtagaagatgtcaaagctaaattagcaactcggggcgtaaaacctgaagcaatcgacgatttattggctaaggataatgaacgccgtgaattgattgtaaagagtgaaaatttgaaaaagtttcgtaatgaagtgtctgatcaaatttcacaattaaaacgtaataaagaagacgctaacgataaaattcaagaaatgcgtaaagtgagccaagatattaaaggcttagacgaacaactggaaaatattgccgaagaagttgaaagcaaagctgctcatctacctaatctaccacatgaagatgtaccggttagtttaactgaagagggtagtgttgaacaacgtcgtaatggaacaccacggacttttgactttacgcctaaggctcactgggaaattggagaagaattaggaatcttagacttcgaacgagctgccaaagttgctggtagtcgttttgtatactacgttggggatggagctcgtcttgaacgagcagtttacaatttctttttagatcaaaataatgcagctggctttacagaagaaatcacaccttacatggttaacgatgcatcaatgtttggaactggtcaatttccaaagtttaaagaaacccatgccggttatgaagtaaaagatgaaggactaactttaattcctacagctgaagtacctttggtaaattactatcgagatgaaattcttgatgaagaccatctaccaatcaatgttacagcgttgtcacctgcttttcgttcagaagctggtagcgcaggtcgtgacacgcgtggtttaattcgaatgcatcaatttaataaggttgagatggtgaagattaccaagcctgaacaatcatggaatgaattggaacaattaactacccatgctgaaacccttcttcaaaaattaggattgccttaccgagtgattaccctaaccactggagatatgagttttacggcagccaagacttatgatcttgaagtgtggattcctgctcaagataagtaccgcgaaatttcaagttgttcaaactgtactgatttccaagctcgtcgcgcacatattcgtttccgcgatgaaaatggtaaattgcaatacgtacacaccctaaatggatctggtttggcggtcggacgtacagtagctgcaattttggaaaattatcaaaatgaagatggaacagtcaacgttccggaagctttagtaccttatatgcaagggacaactgtaattggtaaaaagtaaatagttatctaaaaataagagatcgcattgagatctcttatttttttatggaatccataaaggataagcctctgattagaaatgtttttcagtaaatatgggagaaaaagggtggtttaaagctattaaaaaaattaataaagaaaaattaaattttttttgcaaaagtgattgacataacggagttttatccgtattatatataaatgtgttcacgagagatttatggaggattagctcagttgggagagcatctgccttacaagcaggaggtcacaggttcgagccctgtatcctccattgagaagcgattctcaatggtctaataaaatagaattatttgcgggcgtggcggaactggcagacgcgcaagatttaggttcttgtatcgcaaggtgtgggggttcgaatcccttcgcccgcatatcgattttaagccgacttagctcagctggcagagcatctgtcttgtaaacagggggtcggaggttcgaatcctctagtcggcattttgcggaagtagttcagtggtagaacatcaccttgccatggtgggggtcgcgggttcgaatcccgtcttccgctttgtaccaaatttaatattttgcacccatagcgcaactggatagagtgtctgactacgaatcagaaggttgcaggttcgactcctgctgggtgcatcgcttaaaaaagtattaatcggatatgattaatgctttttttgttttctaaatcaccggtttaaatttgtgctagaatataatggttggcgggaagtagctcagcttggtagagcaccacgttcggggcgtgggggtcgcaagttcaaatcttgttttcccgattgagataggtcaagaataaacttattattgatgtttaattgatggtaagttttttttattttcttaaggttttgatagctttaagacggaataattaatattttttgcaattttctgtcagtctcgtataataatagtcaacattagtcagagtatagaaaggtggtcgttatgcaaggacagaatatttcagatataatcgagcggtatttaaaggaaatcttggctaattcagaggagattgaaattcgccgttctgaaattgccgatcaattcgatgtcgtaccatctcagattaattatgtaattaagactagattcaccattcaaaatggttacgtggttgaaagtaagcgtggtggcggtggatacattagaattgaaaaagttaaacttcttgacgatattgatgttttggattctttaatacgggtgattggagattcattgaatgaacgtgatgcgatttcaattctaggcagtttatatgaagactccgtactaagtaaacgagaagcgagcttattagcctcgaccctttccaaaagtactttaaatattggcgatcgtaatttagaagaacaaattagagcaaaagtgatgattggaattttgaatcatctcagatacgaatagtggagattagagaaagacaggtggaaaatggaaaatttatttacccctagtgcaagaaatgccttggttattgctcaagaacaagcaaaaagatttaaacaccccgcggtgggtactgaacacctgttgttagcattggcaattgagactaatggtgtagcgcgaagcgtcttaggacaattcaatgttacagaagtggacgttgctgaggaaattgagcaatttaccggctatggtaacttacgaacagtaaaagatgattatttaccatattcaccaaaagctagtgaaattttagtcaacgctcaagagcaggctaagcaattaaacgctattaaaattggaaccgaacatttattacttgctttagtgcaaaatgataatattttgtcttcaagaattttattggcgttggatacagatattgccgaggttcgcaaagttactttacgtaaattaggtgtaaatccagctactcaaaatcgacgtagtaagcaacgggctacaagtgctgaaggaaccccaactttagattcagttgcacgagacttgacggcgatggctgctgaaggaaaaattgatccagtggtggggcggacaaaagaagttcgtcgcgtaatccaaattttaagccgacggactaagaacaatccagtattgattggtgaaccaggagttggtaagacggcgattgccgaaggattagctcaaaagattatcgatcaagatgttccaactgatatgcaaaataaacgattaatgatgctagagatgggttctttagtggcgggaactaagtaccgtggtgaatttgaagatcgtttaaaaaaggtgattgaagaaattcgcaatgatggtcaagtgattgtctttattgatgagttacacacgttaattggagctggcggggctgagggagccattgacgcttctaatatcctaaaaccagctttagctcgtggtgagctacaaacgattggtgcaactactttaacagaataccaaaagtatatcgaagctgatgctgctttggaacgacgttttgctaaagtggaagttgatgaacctacggaagctgaagcagttcaaattttaagaggaattcgtcctaagtatgaagaacatcaccaagttaaaatttcagatgatgccattcaacaagcagttactttatcatcacgttatattgcagaccgttttcttcccgataaggccatcgatttaatcgatgaagcggctgctaaaattcgaatcgatgcctctgagaagcaagtgaaaaaagttactgatgaagatcgattagaaaaattacgaacagctaaagaagaagcgattgataatcaagatttcgaaaaggctgccgacatccgtaagaaagaaatgaagttacgccgtaagattgagcgtgctgaaaataacccagaaaccaatgaagctaaaaaagattataaattaattgaaaatggcgaagatattgcgcaaatcgtttcagattggactggtgtacctttaacgcagatgaaacaatctgagtcagatcgcttgattaatttagagaaaactttgcacgaacgagtaattggtcaagaagaagccgtttcgtcagtagctagagctattcgccgtgcgcgttcaggtttgaagagccctaagcgaccaattggttcttttatgttccttggtcctacaggggttggtaaaacagaactggctaagtctttagcagatattatgtttggttcggaagataatatgatcagaattgatatgtctgagtatatggaacgttacagcactagtcgtctagttggatcagcaccaggttatgtgggttacgacgagggtggacaattgactgaacaggttcgtcggaaaccatactcagttgttttatttgatgaagtagaaaaagctcatccagatgtctttaatttgttacttcaagtttttgatgatggttttctaactgattctaagggccgacgagttgattttagaaatactattatcattatgacgtctaacttgggagctacagcattgagggatgaaaaatcagtcggctttggtgctcaaaatgcagctgaagattaccatgctatggcagataaagtacgtgaagttttgaagcagagtttccgtcccgaattcctcaaccggattgacgaaaccattattttccattcattaacgaaacctgaactccatcaaatcgttaaattgatggctaaagatgtcattcagcggatgagtgagcaggaaattaatgccaagtttactcctagtgcaattgatgtggtggctgaagctggatttgatcctgaatatggagcacgtccattgcgtcgagcattacaaactaaggttgaagaccaattaagtgaattaatgttgtccggtgaagctaaggttggtgacgatattacgatcggagcgcgcaacggaaaaattaatttaaaagttaaaaataaaacattaataaaaaataaataatttaacattgcaagttgtttgacaaagcatatggcaaggaataaaatgtaatatgtatgttaaagcagggttaaatgagacagtgcgatctattgtccgcagtgttctagataaaaaagcaaaaatagtttcttatagaggactatttttggtttttttttgctaaaaaacaggtttcagtgcaaactgtaatcaaactgtaacatttaactcgtttagaaattggagaggtgaataacttggcaggacatttagttaagtatggtaaacatcgtacgcgccggagctatgcacgaattaaagaagtgcttgatctacctaatttgatcgagattcaatctgattcgtaccaatggttcttagacgaaggtctccgtgaaatgttcaatgacattatgccgattgaagattttgcaggtaaattatcacttgaattcgtcgattatcaactactagaaccaaagtacacggttgacgaagctcgtgaacatgaagcaaactattctgcgccattgcacgtaactttacgtttaacaaaccacgaaactggcgaaattaaatcacaagacgtattctttggtgatttcccattaatgacagaacaaggtactttcattattaatggagcagaacgtgttattgtttcacaattagttcgttcacctggtgtctattacaacttagatacagataaaaataatcgtaaaatttggggaacaaccgttattcctaaccgtggggcttggttagaatatgaaacagatgctaaagaaatttcttatgtacggattgatcgtactcgtaagattccaatgaccgaattagttcgtgcccttggatttggctctgatgaagaaatcatcgatatttttggtggttctgatagtttagatttcactcttgataaagatgttcataagaatcccgaagattcacgggttgctgaatcattgaaggatatttatgaacgtttgcgtcctggtgaacctaagactgcagatagttcaagaagtttgctaactgcgcgcttctttgatccaaaacgttacgacatggctccagtaggtcgttacaaagtaaataaaaaacttagccttaagactcgtcttttaggtcaaaccctagctgaaacattagctgatcctgatacaggggaagttattgctcaaaagggtgaaatggtcaacaaagacgtaatgaagaaattagcagttttccttgatcgtcctgacttcaagatggttacataccaaccatctgaagaagcagtcgttactgaaccaatgactatccaagttatcaaagttcaagaccctaacgacccagaacgtacattgaatatgattggtaatggtaatatcgatgctaaattgaagcacatcacacctgctgatattatcgcttcaatgaattacttcttccttcttcaagatggaattggtagtacagatgatattgatcatttgggtaaccgtcgaatccgttcagttggtgaactacttcaaaaccaattccgcattggtttatcacgtatggaacgtgtagtacgtgaacgtatgtcaatccaagatgctgaaacagttacaccacaacaattgattaacattcgtccagtagttgctgcaactaaagaattctttggttcttcacaattgtcacaattcatggatcagactaacccgcttggtgaattatcacataagcgtcgtctatcagcacttggacccggtggcttgactcgtgatcgtgccggatatgaagttcgagacgttcactatacgcattatggtcgtatgtgtccgattgaaactcctgaaggccctaacattggtttgattaataacttggcttcatatggtaagatcaaccgatatggctttatcgaaacaccatatcgtcgtgtttcatgggaagatcataaagttacagatcgtattgattacttaactgctgacgaagaagatcaatttgttattgctcaggctaactctccacttaatgatgatggttcatttgctgacgacgtagttatggctcgtcatgaaagtgataacatcgaaactagcattgaaaatgtcgattacatggacgtttctcctaagcaagtagttgctgttgctacagcatgtattcctttcttggaaaacgatgattctaaccgtgccttgatgggtgctaatatgcaacgtcaggccgttccattggttgatccacattctccattaattggtactggtattgaatataaagctgcacatgattctggggttgctcttttatgtcaacacgctggtgtagttgaatatgttgatgcacgtgaagtacgtgtccgtcgtgatgatggcgcacttgatacttacaagctcatgaagttccgccgttcaaatggtggtaagaactacaaccaacgcccaattgttcgagttaatgataaagttgacgcggatgaagtactagctgatggtccatcaatggaacaaggtgaattagcccttggacaaaacccattgattgccttcatgacatggcaaggttataacttcgaagatgcgattgcgattaatgaacgtttagttcgtgatgacgtatatacatcaattcatatcgaagaatatgaatcagaagcacgtgatacaaaacttggacctgaagaaatgactcgtgaaattcctaatattggtgaagatgcccttcgcaatcttgatcaagatggtattgttcgagttggtgctgaagttgaagatggtgacatcttggttggtaaggttactcctaagggggttacagaattatctgctgaagagcgcttgcttcatgctattttcggtgaaaaagctcgtgaagttcgtgatacatcactccgtgttccacatggtggcggcggaatcgttcaagacgttaagattttcacccgtgaaaatggtgacgaattatcacctggtgtaaacatgatggttcgtgtttatatcgctcaaaagcgtaaactccaagttggtgataagatggccggacgtcatggtaataaaggtactgtttcagtggttatcccacaagaagatatgccttacatgcctgatggaactccaattgacattatgcttagcccaatgggtgtgccttctcgtatgaatatcggacaagttcttgaacttcatttgggaatggctgcacgtaacttaggtatccacatgacaactcctgtttttgatggagcccaagataaagatatttgggaagcagttgctgaagctggtatggattctgatgctaagtctgtgctttatgatggacgtactggtgaaccatttgaacaacgtgtggctgttggtgtcatgcactatatgaaacttgctcacatggttgatgataagattcatgctcgttcaattggaccttactcacttgttacacaacaaccacttggtggtaaagcacaatttggtggacagcgttttggtgaaatggaagtttgggctcttgaagcttacggtgctgcatatactcttcaagaaatccttacttacaagtctgatgacgtcgttggtcgagttaagacatacgaagcgatcgttaagggtgaaccaattccacgcccaggtgttccagaatcattccgagttcttgttaaagaattacaagctttaggacttgatatgaaggttctaggtggggatgaccaagaagttgaacttcgtgatatggacgaagaagatgacgatgttgtgaatgtcgatgctcttagcaagtatgctgaaaagcaaaacgaaaaaacaaatgctagcactgaagaagcaaaggctccatcaacggaatcagctcctgttgaaactaaaaacaatcaaaactaattacttaaaagaaagaggaggtcagtccgttgatcgatgttaataaattcgaaagtatgcaaatcggtttagcttctcctgataagatccgtatgtggtcatatggtgaagttaaaaaacctgaaaccattaactatcgaactttaaaaccagaaaaagatggattattcgacgaacgaatctttggaccaaccaaagattacgaatgtgcttgtggaaagtacaaacgtatccgttataagggaatcgtctgtgatcgttgtggtgttgaagttacaaaatctaaggttcgtcgtgaacgtatgggtcatatcgaacttgctgcaccagtaacacacatctggtacttcaagggaatccctagtcgtatgggactagttcttgatatgagtcctcgctcattggaagaaatcatctattttgcttcatacgttgttatcgatgctggtgaaactccactagaaaagaaacaactattaactgaacgcgaatatcgtaataagttaagtgaatatggtgataaatttgtagctaaaattggtggggaagctatccaagctttacttgaaacagtagatcttgaaaaagaagctaaccaattgaaagaagaattgaaggaagcttctggtcaaaagcgtacccgtgcggttcgtcgtctagacattattgaagccttccttaaatctggtaaccacccagaatggatggtactcgatgctattccagtcattccacctgatttacgtccgatggttcaattggatggtggtcgttttgctacatcagatttgaatgatttatatcgtcgtgtaattaaccgtaacaaccgtttgaaacgattgttagatttaaatgcacctggaattattgttcaaaacgaaaagcggatgcttcaagaagcggttgacgctttgattgataatggtcgtcgtggtcgtccggttgctggacctggtaaccgtcctttgaagtcattgtcacacatgcttaaaggtaagcaaggacgtttccgtcaaaacttgctgggtaaacgtgttgattattctggacgttcagttattgatgttggtccttcattgaagatgaaccaaatgggtcttccagttccaatggcaatggaattattcaagccatttattatgaaggaactcgttggtcgtggcttagcttctaacatcaagaacgctaaacgtaaaattgatcgtaaagatgatgatgtttatgatgtccttgaagatgttatcaaagaacatccagttcttttgaaccgtgcccctacacttcatagacttgggattcaagcttttgaacccgttctagtaagtggtaaggccatgcgtttacatccattagcttgtgaagcttacaatgccgattttgatggggaccaaatggctattcatttacctttatcaaatgaagctcaagctgaagcccgtcttttgatgttagctgctcaccatatccttgctcctaaggatggtaagccagttgttactccatctcaagatatggttattggtaactattggttaacaatggaacgagctgaaagtgtcggtgaaggcatgatcttcaacggccttgatgaagttcgtttagctcttcaaaatggttatgtttcaattcatacaagaattggtgttcgtgctaattcaatgcctgaaaagccatttactgatgcacaacgtaaacaaattttgattactactgttggtaaaatgttattcaatgacattcttcctaagggctttgtttacttgaatgctccaactaatgaaaacttggttagtggtacaccggatgaatacttcctcgaaagtggcgaagacatccgtgtacaactaaatcaacgaccattaattgcaccattcaaatctggattcttgagtgacgttatcgctgaagtttacaagcaatataaagttactgaaacttcattattacttgatcgaatgaaagacttaggattctatcgctcaaccctttcaggtttaactgtgggtattgcagatattactaacttgcctgaaaagccagaaattattgctgcagctcataaacaagttgctactgttacaaagcaattccgtcgtggacttattactgatgacgaacgttatgaacgggtaattggaatttggaacgatgctaaagatgacatccaacaaagactgatggaaacatttgatccacaaaacccaatcttcatgatgtctgattctggtgcgcgtggtaatatttctaactttactcagcttgctggtatgcgtggtttgatggccgctcctaatggtaaaatcatggaacttccaattctttctaacttccgtgaaggacttagtgttttggaaatgtttatttctactcatggtgctcgtaaaggtatgaccgataccgccttgaagaccgctaactctggttacttgactcgtcgtcttgttgatgttgctcaagatgttatcgttcgtgaaaaagattgtggaactgatcgtggattattgatttcagcaattgctgaaggtaatgaaatgattgaaccactttatgatcgaatcttaggtcgttacacaatgaaatctgttttcaatcctgaaaatggtgaaaccatcattggaccaaatgagatgattaacgaagctatagcacaacaaatcattgaagccggcgttcaagaagtaactattcgttcagcatttacatgtaacactgcgcatggtgtttgtgagaagtgttatggacgtaatatggctactggtgaccgtgttgaagttggtgaagcagttggtactgttgctgctcaatcaattggtgaacctggtactcagcttactatgcgtaacttccatactggtggtgtggctggtaatgccgatatcactcaaggtcttccacgtatccaagaaattgttgaatctcgtaatcctaaaggaccagccgagatttcagaagttactggtacagtcgaagctattgaagaagatcctgctgaaggtacaaaggatattacgattaagggtgaaaccgatactcgtacttacacattaccaatcacggctcgtatgaaggttgcagaaggtgactacatccaccgtggttcagcattgaacgaaggttcaatcgatcctaaggaattaatcaaagttcgcgacgttctttctactgaaaattacttgctaagtgaaattcaaaaagtttaccgtatgcaaggtattgaaatcagtgataagcacgttgaaatcatgattcgtcaaatgcttcgtaaggttcgggtaatggatcctggtgatactgacattcttccaggtacattaatggatattaatgactttaagaatgataactacaagaccttgattgctggtggtattcctgccacatcacgtcctgtaattcttggtattactaaggctgctcttgaaacaaatagtttcttgtcagctgcttcattccaggaaacaactcgagttcttactgatgctgctattcgtggtaagaatgacccacttgttggtttgaaggaaaatgttatcattggtaagattattcctgcaggcactggtatgacggattatcgtcaaatcaagcctgaagttgtgggcggaaacgttgaacaacctcaatcattaagtgacgttgaaaaagaaatgaatgaaactgttgaataatagtttttagataaaaagctcaccaaattgtggataacacagtttggtgagcttttttattatggtaattttaagaaacgcgatgaattaatagttggttttagctgcttgcgctagctcatcgaatttatcaaagaagagagcggaatttacttgagtaacgaaggttaaaggacgtccgttatcagtaacaaaagtttttccagccgagggaccatcggtgataacagcagctttaattggtttactatcaactaattcaggatatttacttacaagagtagttagaacatcccataaataataagttgagttagcttcaaaagagtgaactagagaataaccttgaccaattaaatctaaagcagggaattggcgctgcttagcccaacgaatacgtaaagctttagtcaagggaacttggttagtactatctaaactaacaatggtaatctttaggtccgtatcaaagacggttttgacagcttgaggatcccagtatgcattccattcagctgtaccatcatgttcgggttcagcaacattaccaaccccgttcattgatccacccatccaaaatagttcatcgatattgtccacaattgtaggatcgatttcgatggcacgagccagatcagttaatggaccagtcataatcaaagtcaccttctgctgagaagctttaatcttctctaacatatctaaatgagctggttgagatgccaatttagttttaggttgattattgttatccaagtgttcgtttaaaatgggaaaatcatcaaatgaaaaagcgctgagacgccattcttttgggaattgatttactgggcgtgaattagatttagcaacttctagggtagtatcttgaccaaaaagatcaatgatttttctagatgctgaaacggcaggttctacataggaatctgctccaactgcccccactccaattaactttgtatctggaaattccaatagtagaagtaaagatacaagatcgtcgacattaccatcatgattaaaataaatattttgcaatgtaggacctcccaaatttattaaagtaatgatagcataaagttcgtatgttgtgtttataaaatgatttttgcgaagtatattaatgatttttactaaaatacaaacattaataaataatatgcagtgaaaaggtatggaataaaaggaattatgctttttttagtaaaaaatagtacggttgctccaagggtagcagcaatcaaaataatgagggtagtcaaatgggcaccaactaataaagtgaaaaataataagatttctatatcgccttgtcctattttttgaaagcaagctaggtgttctaaattattgaataataaaaacgttaatatgagtaaaatagcgaagtttaaccaagaaaaattaaatttgaccaataagtaggctggaaaaattaaaatatgcgtgctaactgattgaacggctacatcctccacggctaggtaactgaggataaaaaagcaaataaaactaaatggtgttggcgaagtggtaggcacgatcgttaaaaagaataaggctgacaatatttcaagcatcacggagtaggtaggaatcgatacgtcgcaaaaaatgcatcgccctcggcaactccaataactaacaattggaaataagcaataatatggcagtggagtagaacagtttgaacagtgggagggcggaaaaatgatggattgaccgactaaacggcgttcataaagcactagaagaaatgatccccaactggcacctagaattcctataagtaaataataaaataagagcatgttatttctccttaacttaatgattggtattagataatatacgaaatagcgctccgtttttttgcttaatttacttgcattcataaaaattgcgtgatattctatttaaggtgctttttgtggacaggttttctgcaaatgcagacatgctgactggaaacgttagccctggtacaagtctcggccgtctttttttatatcaaaaaaagaaccgcctggatatgtgtacttaaagaatacttatttattttcatatattggaaggagaaacatcgatgcctacaattaaccaattggttcgtaagggtcgtcgttcacaaagctcgaagtcaaaagctccagctttgaactacggctataacagcatgaagaagtctcaagttaacaacccagctcctcaaaaacgtggagttgctacacgtgttggtacaatgacacctaagaagcctaactcagctttacgtaagtacgctcgtgtacgtttgtcaaacttgattgaagttacagcttatattcctggtattggtcacaaccttcaagaacatagtgttgtcttgatccgtggtggtcgtgtaaaggatttacctggtgttcgttaccatgtcattcgtggtgcgcttgatacagcaggtgttactgatcgtaaacaaagccgttctaaatacggtacaaagaaacctaagaagtaaggaggttgtgtataaatgccaagaaaaggtccagcaccaaaacgcgaagtattaccagatccaatttataactcaaagcttgttacacgtttaatcaaccgtttaatgttagatggtaagcgtggtaaagcttcaaagattttatacaatgcttttgatattatcgaaaaagaaactggttcagaaccaacaggagttttcgaagaagctatgaacaacatcatgcctgtccttgaagttaaggctcgtcgtgttggtggctctaactaccaagttccaattgaagtacgtccagatcgtcgtacaacacttggtttacgttggttagttaactacgctcgtctccgtggtgaacacacaatgccagaacgtcttgctcgtgaaattatggatgcagctaacaatactggtgcatctgttaagaaacgtgaagacacacataagatggctgaagccaaccgtgcattcgcacattaccgttggtaagattcagtcgttgcaattaatcattgcaaccatgatgactattatatggatgcatatagtagtcattttttctaaaaacagctattactttgatttcatttggaaggagaaccttttatataatggctaacaaacgtgagtttcctctagaaagaactcgtaatatcggtatcatggctcatattgatgctggtaaaacaacaactacagaacgtatcttgtactatacaggtaagatccacaagattggtgaaacacatgaaggtgcttcacaaatggactggatggcccaagaacaagaacgtggtattacaattacatctgctgcaacaacagcagcatggaagaaccaccgtatcaatatcatcgatacaccaggacacgttgatttcacaatcgaagttgaacgttcactccgtgtgcttgatggtgccgtagcggttcttgatgctcaagctggtgttgaacctcaaacagaaactgtttggcgtcaagcttcagattatgatgttccacggatcgtttttgctaacaagatggataagcttggtgctgattttgatttctcagttcaatcaatccacgaccgtttgcaagctaacgctttgccaattcaaatgccaatcggtgctgaagatgatttccaaggaattattgacttggttgaaatgaaggctgatttgtatgacgttgatgaattaggtacagaatgggaaactgttgatgttcctgatgaatacaaagaagaggctgaaaagcgtcgtaacgaaatgattgaacaattggctgatattgatgaaaacatcatggaaaaataccttggtggagaagatatctcagttgctgaaatcaaagctgctattcgtaaaggtactttagctcttgaattattcccagttcttgctggttcagcatttaagaacaagggtgttcaaatgatgcttgatgccgttgttgattatttaccatcaccattggatgttaagccttatagtgctacagatccagaaactggcgaccaagttgaattgattgctggtgatgacaagtcattcgctgctttagcatttaaagttgctactgacccattcgttggtcgtttaacatttatccgtgtataccaaggtacattggaatcaggatcatatgttcttaacgccacaaagggcaagcgtgaacgtgttggtcgtttgctacaaatgcattccaaccaacgtcaagaaatcccagaagtattctctggagatatcgctgctgctatcggtcttaagaacactacaactggtgattcattgactgatccagcacatccattacaattggaatcaatggtattcccagatccagttatcgaagttgctgttgaacctaagtcaaaagctgaccaagataagatggatatcgctcttcaaaaacttgctgaagaagacccttcattccgtgcagaaacaaaccctgaaacaggtgaaactgttattgccggaatgggtgaacttcaccttgatatcattgttgaccgtatgaaacgtgaatttaacgttgaagctacaattggtgctcctcaagtatcataccgtgaagcatttactaagaagacttccgcacaaggtaaatttgtacgtcagtctggtggtaaaggtcaatatggtgacgtttgggttgaattcgaaccaaacgaagaaggtaaaggctttgaattcgaagatgccatcgttggtggtgtagttcctcgtgaatacattccatcagttgaagaaggtttgagagaagctatgaacaatggtgttcttgccggatatccattggttgatgttaaggctaaactatatgatggtagttatcatgatgtcgattctagtgaagctgcatttaaggtggctgcatcacttgctttacgtgctgctgctaagactgctgctcctgttatcctagaaccaattatgaaggtagaaatccgtgttcctgaagaatacatgggtgatatcatgggacaagttactgcacgtcgtggacgcgttgatggtatggaagcaattgctggtgctgaagaaatccatgcatttgttcctctatcagaaatgttcggttatgctacaacacttcgttcagcatcacaaggtcgtggtacatttactatgacatttgatcattacgaagctgttccaaaatcaattcaagaagaaattatcaagaaaaatggcggacatgctgaataatctttaaaattaaagaagttttcttttttcaattatttaattgaaggagaaaacttctttttattttaaatttatttctcaaaacccttgtcataacgctgattatcatgtattattatcaagtaccgttttcaaacgagggagcattatgctctctaaacggtggtgtataagcatagcgttgatgtgaaaggttgcgacacacccggccgctttgccacagggtgtggcggtaattttcacggagcaagtcttatttttaaaatagacgaaggaggtaacacaatggcaaaacaaaaaattcgtatccgcctaaaggcatacgaacaccgtatcttagatcaatctgctgacaagattgttgaaacagcaaaacgtactggtgcaacaatttcgggtccaatcccattgccaacagaacgcacagtatatactgttttgagttctccacataagtttaagaaggctcgtgaacagttcgaaatgcgtacgcacaaacgattgatcgatatcgttaacccaacaccaaagacagtggattcattgatgaagcttgacttgccaagtggtgtagatatcgaaatcaaactataatttaaagtataaacggaggtgtactaatgaccacaaaaggaatcttaggtaaaaaggtcggaatgacacaggtttttactgaagctggagaattaattcctgttacagtaatcgatacaactcctaacgttgtattacaactcaagacagttgaaaatgatggttattcatcagttcaattagggtttgacgacaaacgtcaagttttgagcaacaaacctgaacaaggccacgtagcaaaagcaaatacaaatcctaagcgcttcattcacgaaatcagaaatgttgagcttggggacgtcaaagttggagacacaatcgcagctgacatttttgaagcaggcgaaatcgtcgacgtaactggtactactaagggacatggtttccaaggtgttatcaaaaaagacggtcaacgtcgtggtccgatggcgcacggttctcgttatcaccgtcgtcctggttcacttggggcagttattaaccgcgtattcccaggaaagaaattaccaggtcgcatgggtaacaaaacagtaacaattcaacatcttgaaatcgttaaagcagatacagaaaacaacgtattactagttaagggtaacgtacctggcgctaagaagtcatacttagttgttaaaagtactgtaaagaatactaaataagagaggaggaccatataaatggctaacgtatcaatattcaaacaagacggaactaaaaatggtgacgttgaattaaatgccgatattttcggtatcgaacctaacaacgatgtagtctttgaagcagtagttatgcaacgtgcatctatgcgtcaaggtacacacgcagtaaagaatcgtagtgctgtacgtggtggtggtagaaaaccatggcgtcaaaaaggtactggacgtgctcgtcaaggttcaattcgctcaccacaatggcgtggcggaggaattgtctttggaccaactcctcgttcatatgcatacagcattcctaagaaaatgcgtcgcttggcattgaagtcagtactttcacaaaaggtattggatgaaagccttgtagtcgttgatgaattcaagttcgaaactccaaagactaaggactttgctcaatcattaggtaaccttaatgttgataaaaaagctctattagttcttgaagaagataacgaaagtgctgtattggctgctcgtaatttatctaatgtaaaaatcgttgaacctgaaggtatcaatgttttagatattatgaatagcgacaaacttgtcattacacaaaaggctctttctcaagtagaggaggctctagcataatggaatcacgtgatattattctacgccctgttgttacagaagcatcaatggcgttaatcgatgacaaacgttacacatttgatgtagatccacgtgctacaaagactcaagttaaaaaagctatcgaagagatctttgaagttacagttattaagatcaacattatgaatgttaaaggtaagttgaagcgccaaggccgttacgctggttacacaaagaagcgtcgtaaggcaatcgtgcaactttctgcagattcaaaagaaatccaattatttggtgaagaataaataaatataggaggaaaacaacgtggggattaagaaatttaaaccaactacaaatgcccgtcgtggcatgacacaattggactactctgaaatcacaaagaagagtccagaaaagtcattgttggaatctcaaagccatactgctggtcgtaataactacggtcgtatgactgttcgccatcgtggtggtggtaacaaacgtcaataccgtatcatcgactttaagcgtattaaagatgatgtaccagctacagtaaaagctattgaatatgatccaaaccgtacagctaacattgctttgcttgtttatgctgatggtgttaagtcatatatcattgctcctaaaggtttgaagattggcgacaaggttcaatctggatcagaagctgatatcaaagtaggtaacgcattaccacttaaggatattcctgttggtactgttatccacaatatcgaattaaaaccaggtaaaggtggacaacttgttcgttcagctggtgcttcagcacaattacttggtaaagaaggtaagtatgtacttatccgtcttgcttcttctgaagttcgtatggttcttgcaacaaaccgtgcaacaatcggtgctgttggtaatgaagaacatgaactagttaacgttggtaaagctggtcgtacacgttacgctggtcaacgtccacatgttcgtggttctgtaatgaaccctaacgatcatccacatggtggtggtgaaggtaaggctcctatcggtcgtccatctcctctttctccatggggtaagaaaacaatcggtaagaagactcgtaacaaacataacaagtcaaacaaatttatcgttcgtggtcgtaagcgcggtcgcttaggtaacatctagaacagttttcgaaggaggtcaaattaatgggtcgtagtttaaaaaagggaccattcgctgatgaacatcttctaaagaaggtcgatgcacaaaaagatcaagacaagaagccagtaatcaagacatggtcacgtcgttcaacaatttttccaagtttcatcggatgcacaatcgctgtatacgatggtagaaaacatgttccagtttatatccaagatgatatggttggtcataagcttggcgaatttgttccaactcgcacattccgtggtcacggtggcgacgacaaaaagacatctggaaagtaaggaggatgaatcatggctgaacaagtaacatctgcacaggcaactgcaaagactgttcgtattgccgctcgtaagattcgtctcgtagtcgatcttatcagaggtaaaagtgtcgctgaagcttttgcaattttaaaatttacaccacgtagtgcttcacctgttgttgaaaaggttttgaagtctgcagtggcgaatgctgaaaacaactttgatttggatcgtgaagatttggtaattagcaaagtctttgttaacgaaggaccaacgttaaaacgtttccgtccacgtgctaagggttctgcatcaccaattaacaaacgtacaagtcatattacagttgtagtatcagaaaaacaggagggataacgcgtgggtcaaaaagtaaatcctaatggattccgtgttggtgtcattcgtgattggcaagctaaatggtatgctgataaagacttttcaaagttcttagccgaagatatcaagattcgtgaatttatcgcaaagcaacttactgatgcttctgtatctactgttgaaattgaacgtgcagcaaatcgtgttaacatttcaattcacactgctaaaccaggtatggttatcggtaaaggtggatcagaagttgaaaagttgcgtaatcaactaaatcaattaactggcaaacgtgttcacatcaacattgtcgaaatcaagaaacctgatctcgaagcaaaacttgttggtgaaaacatcgctgctcaactagaaggacgtgttgcattccgtcgtgctatgaagcaagcaatgcaacgctcaatgcgctcaggtgctaaaggtattaaaacacaagttgcaggtcgtttaaacggtgctgacatgtctcgtgtagaacgctactcagaaggaaaggttcctcttcacacacttcgtgctgacgtggactacgcttgggttgaagctcgtactacatacggacaacttggtgttaagacatggatctaccgtggcgaaattttacctgaagtaaaggacgctaagaaaaactctaaagaacaaggagggaaataagcatgttagtacctaagagagtaaagcatcgtcgcgaacatcgtggtcgtatgcgtggtgctgctaaaggtggcaaaacagttgcttttggtgaatatggtttacaagcattaacttcatcatggattactaaccgccaaatcgaagctgctcgtgtggctatgacacgttatatgaaacgtggcggtaaagtttggattaagattttccctcataagtcatacacatctaaaggtgtgggtgttcgtatgggtaatggtaaaggtactccagaaggctgggttgcaccagtaaaacgcgaaaaggttatgtttgaagttgcaggtgttcctgaagaagttgctcgcgaagctctacgtttggcagcaatgaaacttcctgttaagacaaagattatccaacgcgaggaagtaggtggcgaatcagatgaaggctaaagaaattaatgaattaaccactgacgaaatgatcaataaggaaaaagagtataaggacgagttattcaacctacgtttccaattggctacaggtcaacttgaaaacactgctcgccttaaagctgttcgtaagaacattgctcgaatcaaaactgctctacgtcaacaagaattaaacaagtaaaagaatacgaagggaggacttaatcaatgagtgaagaacgtaacgcacgaaaggtttaccaaggacgcgtagtttctgacaagatggataagactatcacagtccaaatcgatacttacaagacacatcctgtttacggtaagcgtgtaaagtactcaaagaaatataaggcacatgatgaaaacaacgctgctaagatgggcgatatcgtaacaattatggaaacaagacctttatctgctacaaagagattccgtttgcttgatatcgttgaaaaagcggttattatctagctcatgtttcgtattctgatacaaaattgaagggaggacactaactgtgatccaacaagagagtcgtttgaaagttgctgacaattctggagcacgtgaactgttggttattaaagtattgggtggttcccgtgttaaatttggttacattggtgacattatcgttgctactgttaaacaagcaacaccaggtggcgttgtcaaaaaaggtgacgttgtaaaagctgttgttgttcgtacaaaacaaggtgcacaccgtgctgatggttcatacatcaaatttgacgaaaatgctgcagtattaattaaagatgataagagccctcaaggaactcgtatctttggcccagttgcacgtgaattacgtgacaaggactacatgaagatcgtttctttggctcctgaagtattgtaatcaaccatcataacgaaggaggtgcgccattaatgttcgtaaaagttggcgacaaagttcgcgtaattagcggaaaagacaaaggcaaggaaggtactattaaacaaacccttgctaaaaagaaccgtgttgttgttgaaggccttaatatgattaaaaaacatcaaaagcctaacaatgcaaatcctcaaggtggaattcttgatgttgaagcacctatggatgtttcaaatgtaatgcttatcgatccatctacaaatgaaccaacacgtgttggcttcaaaactgttgatggtaagaaagtacgagtatcaaaaaaatctggcgagagtatcgacaaataatctaagcgaagggaggaaataatattcatggcaaatcgtttaaaagaaaaattcgttaacgaaatcacacctgatttggttaaaaagtttgactatacatcagttatgcaagtaccaaagattgaaaagatcgttttgaatatgggtgtcggtgatgcagttactaactctaagaacttagatgaagcagttgctgaattggaacttatttcaggtcaaaagccacttgttacaaaggctaaaaagtcaatcgctggattccgtcttcgtgaaggtatgtcaattggtgctaaggttacattacgtggtgaaagaatgtatgacttcttagataagttagttaacgtttcattacctcgtgttcgtgacttccgtggtgtaagtagcaaggcctttgatggtcgtggtaactacacattaggtgtacgcgaacaattgattttcccagaaatcgattttgataatgttaaccgtgttcgtggtttagatattgttatcgttacaactgcaaacacagatgaagaatcacgtgaactattggcacaattcggaatgccatttgaaaagtaagcgaagggagcaaacaaattggctaaaaaatcattagttgtaaagagtgaacgtcctgctaagttctcgacacaagcatacacacgttgcgaacgttgtggccgtccacactctgtataccgtaaattccatttatgccgtatttgccttcgtgaattagctcatgaaggacaaattcctggtatgaagaaagctagttggtaaaaaaagaaatcagagtcaaaggagggtaatactgaatgtctatgacagatcctattgcagactttcttactcgtattcgtaacgcgaacatggttcgccacgaatctttagaagtacctgcatcaaaaatcaaaaaagatatggccgaaattcttaagaacgaaggttttatcaaggatgttgaatatattgaagatgacaagcaaggcatcattcgtgtattcctaaaatatggaaagaacaacgaacgagttatctctggtttgaaacgtatttcaaaacctggattgcgttcatatgttaaatctgacgaagttcctaaggtgttgaatggtttaggtatcgcaatcatttcaacttctgaaggtgtcatcacagataaagaagcacgtgctaagaaaatcggtggagaagtattagcttacatctggtaatttttagataaggaggtgccgttcaatgagccgtatcggtagaaaaccagttgaaattccagctggtgttgaaattaaacaagacggaaacgtcgtaactgttaaaggacctaagggtgaattaacacgtacaatgagctcagatattacaatgtctgttgacggaaacgttgtatcatttgatcgtccaaacgacaataataaaatgcgtgcattacatggtactacacgtgctaacttcaacaacatggttgaaggtgttgtaaatggttttgaaaagaaacttgaactaattggtgttggttaccgtgcacaacttaaaggtaagacattaatcttaaacttaggttattcaaacccagttgaaatggaaactcctgaagaccttaaggttgaagttcctgacaacacacacattaatatcagtggtatcagcaaacaacgtgttggtgatttagctgctgaaatccgtgccgtacgttcaccagaaccatataaaggtaaaggtgttcgttacgttggtgaatatgttcgccgtaaagaaggtaaaacaggtaaataatcacgcagcttgatataattagctgagattcaaaaaatatgaggtgaaaattttgatttctaaaccagataagaacaaaaaacgtcaacgtcgtcacgcacgcgttcgttcaaaaatctctggtactgcagagtgcccacgcttaaatgtataccgttctaacaaaaacatctacgctcaagtaattgatgacgtagcgggtgtaacgctagttagtgcctcaacattagatagcgaaatttcaagtggctcaaagactgaattagcatcacaagttggtgctttagttgctaagagagctgttgaaaagaaaattgaaaatgtcgtttttgatcgtggtggatacatctatcatggtcgcgttcaagctttagctgaagctgctcgcgaaaacggacttaaattttaaggataggagggaaatacgtacatgtctaaatttatcgatccagaaaaattggaaattgaagatcgcgtagttgccatcaaccgtgttacaaaggttgttaaaggtggacgtcgtcttcgttttgctgctttagtcgttgttggtgacaagaacggtcatgtaggttttggtactggtaaagctcaagaagttccagaagctatccgtaaagcggttgaaactgcacgtaagagtttgattgaagttcctattgttggaacaactctccctcacgaagccgtcggtgtttacggtggtggacgaattctgatgaagccagctcttgaaggttctggagtagctgctggtggtgctgttcgtgccgttatggaattagcaggtatcgatgatgttacaagtaagcgtttgggttcaaacactgctgttaacgttgttcgtgctactttcgaaggtcttaagagcatgcgtaatgcagaagaagttgctgcccttcgtggggtttcagtcgatcatttagctgaataaggaggatattctgatgtcacaattaaaagttacattaattaaaagtgctgcacatcgcctcccaaaacaaagaacaattgttaaggaattaggtcttggccgagtaaatagctctgtagtcctacctaacaatgaggcaactcgtggagctattttccacattgcacatttaattgaagttgaagaagtaaaataatttttgtaagattggaggtttccttgcatgaagttgaatgaattaatgcctagcgaaggttcacgcactaaccgtaaacgtattggtcgtggtacttctagtggtacaggtaagactgctggtcgtggtcaaaagggtcaaaaggcacgtggtaaagttcgtttaggttttgaaggtggacaaatgcctctttaccgtcgaattccaaaacgtggattcacaaacatcaaccgtaaagaatttgctattgtaaaccttgatgctcttaacgtttttgatgaaggtgctgaagtaacaccagaatcattgcttaaagctggtatcattagtaaacaacttagcggtgttaaggttcttggtaatggagaaattactaagaagcttactgttaaagctaacaaattctctgaaagtgctgtaaaagcaatcgaagctgctggtggtaaaaccgaggtgatttaatgctgacgactgtcaaaaatgctttaaaagtgaaggatattagaaataagattctgttcacactcggtattttgattgtatttcgtttaggatcatatatcactgttcctggtgttaatgcgaaagcattggaaagcatgtcttcatcaggattagttggaattttgaatacgttcagtggtggtggattaacgaattactccattttcgcaatgggggtttcgccatatatcacagcacaaattattgtacaattgctacaaatggatatcgttcctaaatttgtggaatggagtaagcaaggtgaggttggtcgtcgaaagcttaatcaagctacgagatggttaacaatcgtccttgcttttgctcaatcaatcggaattacagctggttttaattatttaagtcagatgaatttggttgaatcaccaagtgtccaaacctttctaacgattggtttaatccttacggccggaactatgttaactacctggttaggtgacatgattacggaacgtgggattggacaaggagtatcaatgattatctttgcaggtatcattgctcgtacaccagttgggattcagcaaatttacactgagcagtttgttaatactgcgaaaagcgaatggacgcaaagttttattattgttggagcaattatccttgcagttttagccattgtaatttttgttacatgggtacaacaagcaagtcgtaaaattccaattcaatatacaagaagagcttctggcgcttctgatagtagttatttacctcttaaggttaacgtagctggtgttattccagttatctttgctagttcttttatttctacaccgcaaaccattttaatggcttttgcatcatcacattctgatgatacttggtacactgttttaaacgatgtattcaatatgcaaaccactaaaggtgccatcttatatactgtgttaattgtattgtttacgttcttctatgcttttgttcaggttaaccctgaaaaactagctgaaaatttacaaaaacaaggcagttatattccaggagtttggccgggaaagaaaacccaagattatatgtcaggtcttttaattagacttagtgtagttggggcattattccttggcttggttgccttaattccattgcttgcttcaaacatttttggtttggacgaatcaattggtttaggtggaacaagtcttttgattgttgttggtgtagcaatcgagttggcaaatcaacttgaagggttaatgatgaaacgagaatacgttggattcattcgaaaataattcgttagtttaacaatgaaggagaatttcaaatgagtaaattaaacctcgttttgatgggtcttccaggtgctggtaaaggtacacaggctcagagaattattgaggatttcaaaattccacatatttcaactggtgacattttccgtgaagctatgaaaaatgaaaccgaaatgggtgtggaagcaaagaagttcattgataagggtgaacttgttcccgatagtgtaactaacgggatcgtcgaagatcgtcttgcaatggacgatgtcaacgatggttttatgcttgatggttttcctagaaatatcgatcaagctaaggcgctagatgaaatgacatctcgtttaaacaaaccacttacagcagtgattaacattcatgttgatcctgaagttttggttgaaagactatctggcagatttatttgtaaaaattgtggagctacttatcataagctttacaatccaccaaaggttgaaggaacttgtgatgtttgcggacatcacgaattcttccaacgtgaggacgacaagccagaaactgtaaaaaatcgcattgctgttaatactaaacttaacactccgttgatttcttactatgaagaaaagcatctcctttacaacattaatggcgatcaggatatcaacgatgtttattctgaagtcaaaaaagtattagaggctctctaatttcgtgcttgttggtactatagataacgttcattgtttgcaaatagttttttcgtatggtaagctaattcaggtttagcttcgaaatacatattttgaggctttttgttggttattactattagaaaagttaatgggaggcacaaatttagtggctaaagataatgtcattgaaattgagggcacagttaaagaaactatgcctaatgcgatgttcaaagtagagcttgaaaatggtcatgaaattcttgctcatgtttcgggaaagattcgcatgcactatatcaaaattctacctggcgataaggttacggttgaaatgtcaccgtacgacttgtccaaaggtcgcattacctatcgtttcaaataagttttattcgtttaggaggatttattcatgaaggtacgtccatcagttaagacaatgtgtgaacattgcaaaatcattagacgtaaagggcgcgttatggtaatttgctcagcaaatcctaagcacaaacagcgtcaaggaaaataatattatacttggaggtgaaatttaatggcccgtattgcaggtgttgatttaccacgtgacaagcgaattgtcattggtttgacatatattttcggtattggtaacactaccgctcaaaaaatcttaaaagacgcagaagtatcagaagatatccgcgttcgtgatttaacagccgatcaagaagacaagatccgtgcagaagtagataactatctagttgaaggtgatcttcgtcgtacagttagtctcaatatcaagcgtctccaagaaatcggttcataccgtggtatgcgtcatcgtcgtgggttgccagttcgtggacaacatacgaagaataacgctcggacacgtaaaggtaagaaagtttctatcgcaggtagaaaaaaataattaaaggaggctaactttttatggcaacgaaaaagaatactcgcaaacgtcgagtaaaaaagaatattgaatctggagtagcacatatccattcaacattcaacaatactcttgttatgattacagatccccaaggtaacgcagttgcttggtcatctgctggtgctcttggatttaagggtagtcgtaagtctacaccttttgccgcacaaatggcatcagaagctgctgctaaagcagctatggaacatggtatgaagaatgttgaagttgctgttaagggacctggttcaggtcgtgaagctgctattcgtgcattacaagctactgggcttgaagtaagtgcaattcgtgatgttacaccagttcctcataatggatctcgtcctccaaagcgccgtcgtgtatagagttcggttctgtttgagggcaaactttataatgcattcaaaatcgaaatgcagactgcgttttgaaaggggtaaaaattagaatgatcgaatttgagaagccaaaaattcataaaattgacgaaaatgacaattatggccgatttgttattgaacccttagaacggggatatggtacaacgcttggtaattcacttcgtcgtatcctattatcatcattgccaggagcagctattactagcgttcaaattgatagtgtcttacatgaattctcaaccattgaaggtgttgtagaagacgtaacacaaattattttgaatcttaagaaggtttcgttgaagattgaatctgatgaagataaaacattagaaatcaatgttgcgggacctgctaatgtaactgctggcgatattatgggagacggtgacgtagtgattcttaatcctgagttaccaatctgtactgtagctgaaggtactacattccatgcagtactcactgctgacactggccgtggatatacatctgcggacgaaaacaaggctcgaaaggttgatatgccaatcggtgtattaccaatcgattctatttataccccaattgaacgtgttaattatcaagttgaaaatactcgtgttggtcaacgagacgactatgataaacttacgctcgatatttggactgatggttctatcactcctagtgaggcaacaagtttatctgctaaaattttaacagaacaccttgcaatctttgttaaccttaatgatcaggctaaagagactgaaattatggttgaaaaagaagaaactcacaaggaaaaaatgcttgaaatgacaattgaagaattagatctttcggtccgttcatacaattgcttaaaacgagcaggtattaacagtgttcaagaattaactgaccgcactgatgctcaaatgatgaaagttcgtaatcttggacgtaagtcattggttgaaatccaagagaaacttagtttattgggcttaggtttccgttcagaagactaatcataaggagggttcccatagatgagttatcgtaaattaggtcgtacaagctcccaacgtaaagcgttgcttcgcgatctcacaacagaattaattgttaacgaaaagatcgttactactgaagcacgcgctaaggaagttcgttctactactgaaaaaatgatcacattgggtaaacgtggcgacttgcatgcacgtcgtcaagctgcagcattcgttcgtaatgttgttgctgatgttactgaagatggtgaggacgtaaaagtttcttcatcacttcaaaaattgtttgctgatttagctccacgttatgctgatcgtaaaggtggatatactcgtatctacaagacgatgccacgccgtggagacggtgccccaatggttgttttagaattagttgattaattaatttaaaacgattttaataataacaaaatctatcacttaagataatggtagggtgttacgatgttggagaaatcctagtctagcccacggcgagtttttaacttgctatcattatcttcagtgattttttttgtatagaatgatagaattaagtccatattgtttagggagataagagactttgaataacattattgacgtaaaaaatcttacatacaaatatgcaaatagtggtgacaaaaaagcacttgataatgtttcgctctctattgaaaagggtagttggacttcaattgttgggcataatgggagtgggaagagtaccttagcacgttcgattgatggattgatgtcatataacgagggtgtaattaatgtagatggaattattttatccgatgatacagtttggaacattcgtaagaaaattggtatgattttccaaaatcctgacaatcaatttgttggagcaacggtcgaagatgatgtagcatttggcttagaaaatttaggcattgaaactgacaagatgcataagattgtcaataatgtcttaaaaaaagttcgaatggaagattttaaagagagacaacctgaccaattatctggtggacaaaagcaacgagtagctatcgctggggtgttagcttcaaaacctgaaatcattatcttagacgaagctacaagcatgcttgatcctcaaggacgctatgaaataattaatttaattaatgaaattcaccaggaaaatgatattacggtcatttctataacgcacgatgtaagtgaggctatgctatcagatcatgtcattgtcttaaatgatggtaaaatcgtcgaatctggtgctcctaaaaaagtatttaatgatgatgaaatgttaaagttaaccggcttagaaaaaccatttaatgcacatttatttgatgccttagtcgaacaaggaattcatcctccagtagaattacgaatggacgaaaatgatttggaggaatggctatgtcaattgcttttgaaagcgtagattttgtttaccaagcacatactccgtttgaaaatctatctttaagaaacattaatttaacgattcctgatggatcatatactgctattattggtcatacgggaagtggcaagtcgacgctgattcaacatgttaatggactcttacgaccaaccaagggcttggtcaatgtcgatggacaaataattaatgctaatactaaaaataaacaattagtttccttacgccaacatgtagggattgtttttcaatttcctgaaagccaactttttgctgaaacggtagttgatgatgttaagtttggtccattgaactttggagtatcagatacagaagccacgaatcgagccaaagatgcattacaaaaagttaagctaccagaagaattttggcagaagtcaccgtttgaactttctggtggacaaatgcgaagagtagcaattgcaggtgtgttggcaactaatcctaaaatccttattttagatgaaccgactgctggattagatcctcaaggaagatttgaaatgatggaactttttaatgaattacatcataaagagcaacttaccattctattagtaacccatcaaatggatgatgtggcaaattatgcagataatgtcattgtgatggatggaggacagattgttaagaatggtgctccggttgaagtttttcgagacactaagtggctaataaaacatcaactaggattacctaaagcagcaaattttgccagcaagttagctgataggggagttaaatttgataaaatgccacttgatattagtgatctagtacatcagattgttaatgtcaaagataggaggccaagtcatgaataaaattctatttggtcgttatgtccccggcacctcatttgtacatcgaatggatccgcgcgctaaattgattttgagtttgatctatattgtggctgtttttatggctaattcatggtcagcatatgcggttagttttataattgctttgactatcattgcttcatcaggaatagcctctaaattcttctgggacggcgttaaaccattaattggagtaattctattaaccgttgtgattcaggtcttcttcggcgtcggaggacacgtctattggcattggggaatattatctatcacgagtgatggcctgttaaatgctgtttacattgcaatccgatttgtcctgattattctggtatcaacggtattaactttatcaacatcaccactagagatatcaggagcaattgagtcactttttatgccacttaaaaagattcattttcctgtttatgaaatggcgttaatgctatcaattgcattaagatttgttccaacattaatagacgagacagaaaaaatcttgaatgcccaacgctcaagaggagctaattttagttcgggatcaattatggccagattaaaaaagttagtttcaatattgattcctctttttgaaagtgcgtttaatcgggctgaagaattagctacagcgatggaatctcgtggctaccagggcggcgaaggccgcagtaagtatcgagttttaaattatacaaaaaatgacataataggtacgatattcatgatggtttctgtagcattgattatggtactcagaaattggagttagtaatgcgatataaaataatattagcctatgacgggactaattttgcaggttttcaaatgcaacctaatcagcgaactgtggaaggggtcttaaaaagaatagttaataaaatagctaaaaatccaaccccggaaatttcagtttatggatcaggacgtacagatgctggagtacatgctttaggacaagtggttcattttgatttatccattgaaatgtcagaacgaagcatgttacatgcattaaatagtcaattaccattagatatgcaagtaaaaaaggttgaaatagttgatgaaacatttcatgcgcgttttaccacacatggtaaaaagtatcagtatcgaatggctttgggacaattcgtagacccgtttaaaagaaattatacaggccactggaaattccccattaatattgggttaatccaaaaagcgattaaagatttagaaggtactcatgatttttcgagttttgttgcatcagggagtaccgtaaaagatcatgttcgaaccatttatgaagctaaagtatgggaagataaaaaacaaaatgaaatcgtgtttgaattttatggcaatggcttcttatacaacatggttcgaattatggtggcagttttagttgaaataggtagtaaacgtcgtccagcagatgatataccacgtctctttgaagttaaggaccgaaatcaggcccgggggacagcacctgctagcgggctatatttaaaagaagtagattattagatttttgattgactttaatagggactgttaatataatggaagttggtattgtttacctccacaaaataagccccggaaacttattaaagttgagttaaacaaaacagaaattggaggaaattcaagtgcgtacaacatatttggctaaaccaggtgaagtagaacgtaaatggtacatcgttgatgctacagacattcctttgggacgtctttcaacagtagttgcatctattttgcgtggtaagaacaaaccaacattcactcctaatgtggatacaggtgacttcgttatcgttatcaatgctgaaaaaattaaattaactggtcgtaaggctactggtaagatttactatcaccatacattacatccaggtggtattaagtctaagactgctggtgaaatgcgtgaaaagacacctgaacgtttgattgaaacatcaattaagggtatgcttccacacaacactcttggtcgtaagcaagctttgaagttgcatgtttatgcaggttcagaacataaccaacaagctcaaaatccagaaaagcttgacatcacgaacttaatttaaggaggaattgaattttggctgaagcacaatatcgcggcactggccgtcgtaaaaactccgttgctcgtgtacgtcttgtaccgggaaccggtaaaatcacagtaaatgatcgtccaatcgaagaatacattccatttgcaaacttacgtcaagtagttgtacaaccatttggtgtaactgaaacaaacggtaactatgacgttattgctaacgttaatggtggtggattctcaggacaatctggagctatccgtcatggtatcgctcgtgcacttttggatgttgatcctgatttccgtgcacctttgaagaaagctggtcttcttacacgtgaccctcgtatgaaggaacgtaagaaatacggtcttaagaaagctcgtaaggcagctcaattctcaaaacgttaatatttatattttcgttcaaaacactttcctttgggagagtgtttttttgtttaagatgtaatctaagaaatatcaaatattttatttagtagttaattctaaaatttagtgattgctaattttgaattatagtaaaaaggattgatctctattgtaatatagaggtcaatcctttttttagatatatcatatgatagcagtataaatttcattgtcattttaaaactcttactttctcaccgagcgcaatttcaaatgaaatataattaagcttgcttgacgttttctagtaacattataattaaagttcacaggatataacgggcattatgagctttataatagtaatgtaaatttgtttaatttttagtacaataacccccatgaatcgatgcacaacgatccgtgggggttattaattgcagtgataaaagaagtatatacgttaattcgagatggggaagtaagctggggtacttactttttaataacttcggacagtatcactgcaattgtatttttatattttttaaggggtattgatataggattataccagagattgatctatgacaaacttttttaaagacctactattcttcgaaaaataaacttaaaggaacattgtattgtttatgaattaatttgatttcagaaattttaaactcacttgaaccatttaattttcgatttaaggtcgtgcgactgataccgaggtaatttgccacgtcttcttgttttatttgcttagcttttaggtgttttaatactccttgcgaagcttgggcatcgtcattcatatatttcaccatcctattatatttttatatactccttatagagattcctcccatgggattataatacttaagggtatccttttcaatatttgttatgctttaattaaaatgtatgtactgaaattgaaacattcgaatataaaggaggattccgtccttgatttttagctcggttttaagaaaggctcgtgaagaacgtaaaatgagccaaattgaattaattcgcaaaatccatgatgaatatggaattgatatatcaactagtatgttatctcgttatgaggatgagttgactccattgccaagacgaatgtcaataaaagcaatgtttgcactatcggtttatttagatattgatttaaatgaacttgctcggaaagaagttgaaaaaatcataaagataaaaaatagtaataaaaaataaattatcagcatagtgctacaagagcactatagcataggttttaaatacatgctatcgattaactgacttttatataactaaaaaactctttttaagaataatggcgactaatggaataattttactaagtctaactgaaagaaatacaaagaagattgctaatgtttaaaagcttttagaataaaattcatattctttgaaatagaaaacagtttcatttacactgtaggcgtagatgataagttataagtttgaaaggggtatgtaaaatgtcagaacataaagcacaatttcctaaaacaatggaacaactcaatcaattaattgcagatattagtcaattagaaactaatattcagcaaactcattggtatatgcgtggatcagaattctttagattacatcctcaaatggatgaatataacgaagaattaggtgaacaacttgatgaaattgctgaacgtttaattgctctgggtggttcaccatatgctacaacgcatgaatttattgatcataccggattacccgacgaaaagataacttggaatcaatattcattaccagaactaatgcaacgccttaatgatcaatttaagtatcttgccagtcagtatcggattggtatggaagtatcggatgaagaacgtgatttctccactcaagatatgttaaacggatttagggcagaagttgataaatggatttggatggttagtgcatatcttaaccaaggtcctttagataaatagaattttttataaataactgaaaaggcttagccgttgaaaaacagctaagccttttagattgaattgatattttaatcatctccatgatgatcagcgtagtaatcatttgatgcatattctttagcaagcgctggagatttataataatgagcagtagtggctatcattgcaccaccggcttccgtcagcacttcaatttttttaccgtccacagtttgagtagtgttatagtaataagttccatctccactgccttggtaccagcctcggatatttactatcctagagggattttcgtctcctttaaagataccatcattactttccataaacgtcacaacaacccagttatccttactagtatcattagcatcgtaagtaatttctgagggatgttttgaagcctcgaaagctttgtcagttttccccatacttttccaaaggttaccatcaaaagaaacggtttgaattttatcctcatcagtgtacgtataccaagttccttgcattcgtgaaggaaatacaaatttttgatcatttgtatctgcggttgtatctgatgaacctaatttattagatgacttagtggttgcagattttggagtagccgtttttttgctattaacaatatttttaaatccgttacttaaatctgtattttgagtaggttcaaaatgaactaatccatcgggagttccttgattttgttcagtgtaatagacaataggagtatgatcctgaatggtaaatagataaattcgcccgccaatggttgaaccaccattagtatcttcataaattgctaccacatttactttatatttatttgaaccgtctggcgaccagccagcagacagcttatggttgctaaaagcagttttattgtcggaaaaatcgttgggataatgtaaaccagtatatgttgtatttctatctggagtacattgagtatagctttgtttcatagtttgtccccaattaaccatgaaggaagctaatttatcatccttagtatcattccagacactcgaactttgattgctagaattttttgaataaaaacttttagcggtagagtgcttttttgtgttagaagaggtgtctgttgttttagtattactgctagtagcgttggtagtattttgcccacaggcgctcagaagtaaggtacaaagccctaaaagtaacgttaaagtaattttattatgtgcatttttcaaactgatttcctccaaaaagatttaattaatgctactaacattgtactccaaaacgttaatcgattaaatctaagtataaatcatatttgactgcagttcggagcttcaaattagctttaacaatgggtttttctttacctttaacggtacgatattgttgttctactgaatctgaatcgaaatcaacttgtcctaaataataaaaatcagagccttcatcgtcactttttttaacaaaaagtagtaaatcaatcgtgttattttggttaccttctagtagacgaactacttcattagagtcaagacgacgagggcttttagtataccaacttagtaaagaagaattatagaaaacgttgttatggtttaactcatcagggatgtccgctcgtttctggtaagtaacaaacataggacaaaatcccattttttctttataaccgtaaattgcggaagattggtctgtaggccagcctaacaagctgttgacttggcgacgtgtgtatttttgatagagtgtaaatttggtattcaaatcatagttcttactattaattaatccagttgtaattacgtcgtcgactagttttttaaagtaggagttattttgatatgaattccaaatcgattcattcaaatggtaagtattttcaatcaaagttatcatagcagtattgccatattttttgctgtcattaggctgataataagttaagtctagatgtttttccaatgaggtaatagttgccacatcagtataagtacccatttggcttagttcggtgattaaatcatttttggaatatttaccattattagtaaataaatcctgtaataaaattaattcatgaacacgcatgccgtttaaaaattctcgcgaaattaagcgcagaaagctatcctcgagcgtagttaacgcctgctggtcatgcattttaaacaaaaattgatgataattctcatatttatccacaaaaatttgagcattggtagagccgtacttttgaaaatcaaccagtaaaggaactcgaccaagtttgtttttcaagtcgatgtatgaagcacgtaacttcgtgaggagggtcaaattactattattgatggaattatagatttgttctcgcgcaatttcactaaaattaatagaagaaagtccgaccgtttgattaatagatattttgttacgaaggctatttttgtttaacgtttgatcaccagtaagggcaataggaatcatataattattctggtaatttccaatgaagtcaataatggtgacaaagtccttaccttcacttttacgcaagccacgacctagttgctgaataaagataatgctagattctgtattcctaagcataataacttgattaattttaggtatatcaataccttcattaaaaatatcaacagtaacaaggtattctatttcgccgttctcaaactttttgatagttgcttcacgattatccacagagtcctcaccagttagtgcaacggttggatgacctttttgcgtcataatttgggctacttcgtgggcttcttcagttctactacaaaaaattagaccataaacctgatcgccatcatgtccgtagtaatcaatttgttgttctacataatccatgcgctccctagaaactaagtatttcagaggcgtattatctgtgatgacttgtccctcatactcatagtcagtaattccaatgtaatgaaattcactcaacattttttcttcaatggcgtcctgaagccggatttcataagcaatgtgataatcaaaaagttcgtatatattaaaatcatctgttcgctcaggtgtggcagtcatccctaacagaaattcaggcttgaagtgattgattattttctggtaggaagctgcaccagctttgtgagcttcatcaattaaaatatagtcaaaagtattagccttaagttcatttaaaatgtctggtctagaaagggtttgaatcgtagcaaaaacgtattttcggtcaatttctttagttccaccagcgaggataccgtagtcatccgctggtccgcctaggacatttttaaaactaagcaaggctttgcggagaatttgttcccgatgaaccacgaataaaaatttacgaggccgataattacgcacatcaaaggctgctaagtatgttttaccagtaccggtagcagagataattaatccgcgcttctgaccttctgaacgtaaattaatcaaagctttaagtgctgcttgttgcattcggttaggcgttaaaggtgatttgttttccaattggaatggagtagtggggctggatagagacacattttctgaatagaatttggcatactgatcaatccatttttgatttaatggttgggctttttgccattgtttctcaacttcttgattgatttgttcagctaaacgtccttcagtttttgaagataatttgagattccattcatagttttgaattagggcattactggtcaaatttgagctaccgattaaaaatgtttgatagtcagacttattaaaaatgtatcctttagcatgaaagtcactatcagcgtcggcaatccgcacttcgacattgggaatttttaggagttccgcaaaaattttaggttgattaaaatttaaataagttgaagttataattcttccagaaacgtgatgacgggctaaatcagcaaaggttacctttaaatcggttaatactgcattagaaataaatgctacagcaaaagtaaaactcgtacaggttcgcaattcttgctctaggtgatgttttaatttttcgtgtggagtattagcaattaattgtggcgtgaattcagttttagtagcgatatttttatctaataatgctgacaaaattgaatttgaaaaattggtatttaaatccatagataaactcctaattggaacatttgttctgttttttacaattataacaataattctttaaaagcatatcaaagtagggaaactgttaaaaaaagatacttagtcctttaacccaataaaaattagccggttaaaacttttaatacgtctttatagtctttacagttacataacaaaaataaagaatttaggacacgttgtagttaaagatgtagaataatctaagtgtctttataagagataagttaaatagaatggaaatggtgggtggatctttttggcgttaatcggattgatcatttttataattgctcagctaggttatgctgggtcaattagaatggtaagggttaataaatacatggcatggattacttcaatgataatccaaaccctacttctatgcataatggcgatgttaaactggttaaggtttgggcttcgcgcggttgttattttgggctgtattttattcttggtacgtatggtaatggcgatcttcaagattcaaaaaatatcatttgaaggttttcattattttgatttgtggatgattgtgattggactttcactaggaacgactttatatagcagtcctttgcttcactatgataattattcccactgggctttaattgttaaatatttattgttacaaggacacttaccaattgcttcagatgcaattatttcgtttacttcatatcctccggcaacggctttatttatcactcaatttctaacttgggttggattcagtagtggtgcgatgttagtaggacaatttttactaatttgggcgggactttatgctgtttttgcggtattaagagattatacaaggtcaaccaatgcttttattttatgtctcaccatttcactcattaatgtgttcaacattgccattcggatgaacaatctattagttgattttatccttccggtagttgcagcagctggcattgccggtgtctatgtgtatcgacatcaaccacggttgcaatgtgttacagcctttttgttcggttcagagttatttttaattaaaaattctggaaccatgtatgtggttatgattggtttttacttattatatttgttaatgaagaactctaaagaaattaagtggtttaagcgctttggaaaaagtttgggtctaacagcccttacgatggtggggagttacctatcatttttctggtggaatcagcatgtccatgccacttttagcaccgtttctaagcatcaaattagtacatctgcatataaaaatcaattagctagtgaaagttcaaaagtaataatgaagattggtaataagtttttacatcaaattttcagtttggattcactatcaactaggggttttttactggttaatttaacgctgataatcgcgtgggttgttattcgcttgtatctcaagaaacctaataatttactcaaagtcctactagctttagatgctagttttgttgcatactatctcagtgtctttgcgatgtatattgtatcaatgccttattcagaagcaattaatttagagggttctgaacgttatttatctagtatggtaattttaaacatgttgttagccacgatggcactcgtcgtagcgatggaccgagcgatgtatgagcctgatgtaagtaaacgtggaatacgaagtttcaaaaatattattacaaaaaatacttaccaattatctgccttagttttagctttattttcaaccattctgatgttctcagaaattaacgggattaagtatcggagcacaattggaaaagaagagttaccggtagaacttaatcatattgccaaacaagatatgaaatacaatcatactaaagtattagtagttgatccgcatacagctgacgttaatgactactatgctggatatgttagtaaatactatttcttctctgataaagtagatggacgcgaaaactttatgttgtccaattcagactttaaaaaagttgttcaaagataccaatatgtggcattaccggaatggcaccgaactttcacaacaatgttgagaaaaacatatcacgaagattataaggtaggcttgtataaaattaccccaaaaggtttacaaaaagttaatcaaattaaaaattaaaaaaacttggtacgtagcaataataacaactctagggagtctattaaaattactatgtaccaagtttttttagtaaccacgagttaaatcaacaatatttgtatcaggatgcccatcttttagaaaggtttgtaagttgtggacaaacacaccctgaacacctggcagcatctcagagcttaccgctgaattatgtggtgtaattaaaacttgtggataatcccatagtgggctatctgaagcaagtggttcttcttcgaaaacatctaatgcggcatgtttaacgcgaccatcatcaagagcttgtattaaggcagaagtatcgactgatggtcctcgaccgacattaataaatagatataaatgctctaattgattaaagaattgatggtcaaacatatgagtagtttctggagttaaggggagaatgttgacaataatatcagcatcttgaatgatatttgaataagcgttatctgctacggtatcatcaaaattagtagcttcatgaccagaatggttaacaccggtagtataaccacttaaagctttagcttctcgagcaatttcttgtccaatgtgaccagtaccgaaaattaaccattttttatttgagagtagggttagttcctcataatggcgactaccatcccattgcttttggcgacgcatattaagagctaaattcatatcgcgcatgaagtataaggcatataaaagaagcgtattggcaatggcttcgctgtggacaccgctagtattggttaaagtaattttttgacctgtaagttgttgtttaggaaaataatcaattccagcactaaaagattgaatccattttaactgatggtgaggagtatctaatagagattgcacatgatggtcatagccccaagcaacttggatttcttttaagtctgccttagtaatagacgaactattaaggtatgtcacattgtctttgggtaaattagtcctaatttgtttaggaatttggtcggatatataaattttcatcttaatcctcctttgattaatcgcctcaatgatataatatatagaatactttttacagtaaggagctttaacaatgacaagaaaaaccaacgctgggaagattagtatacttgcgttatttgcagcgattattattattcaaaattatgtcccactattaggatatatccccgtaggaatatttgtagtaactacaattcacatcacggttgttattgcggcgattgttctagggccggtagacggtgcgatagttggtgggatttgggggatcgttgattgggtaaaggcacttactttaacagcgagtccttttagtaacatcgtgatggctaaccccatggtatcaattgtacctcgcattttaatcggtttagtaacaggattggtagtcaactggatgataagaattaatattaaacaacagattactttgattatcgggtcgatcattggctctttggttaatactagtttagttttaagtatgatctacgtcttttttcacaatggttctggaatttatgcagctctcaatattcaagatttgatgccatatttattgtctgtggcgggggttcatggaatacctgaggccattgcagcaggtgttattgcaccgctaatttcaattccgctgttaaaatatactaaagtgggacaagaaagattcagacaatatgaaagaaaaaattaatttttaacttggttagttgtcacaggactatgatttttttgatggttcagttaaactgaatacgtacaccaaaatgaagggtctggattgcgagtggcgaagagaaaaagaagacgaaaatctagttctttttataatcgaggtcagttacacgtttctaacttgatcggtgttttgttagcattatgcctgattgtagcagttagcatgaagttatatgtcactcagcataatgtcgtggacgatagtgtggctacggaagcatctaatgatgctcaacatcagcaatttattaaaacaattggaccgtatgcccaacaaatgcaacggcaatatggcatattacctagcattacaatggctcaagcaattttagagtcggattgggggcagagtaccctatctaaaaagtttaataactactatggaattaaaggtgattctgattctaatagtaggtattttaagacgcaggaattcgtaaatggtagatgggtaactgtttcagctcgatttagggtttattcttcatggcaagagtcaatgcgagatcattcacttcttttggttaacggaacaaattggaattcgcaacagtaccaagcggtcatcaatgcggcagattatagacaagctgcgcaagcactgtatgatgcccaatatgcaactgatccggattatcctagcaaattaattaatttaattcaaaaatatggtttaaataactatgataaatagggggatattatgaagttacttgaagataagattaagtccgaaggaatcgtattaccaaacaacgttttaaaggtagatggttttttaaatcaccaggtggatgctcaattgatgtttgaaattggcaaagaatttggacgtttatttaaaaaacagaacgtaacaaagattttaacggttgaatcttcaggaattgcccctgctgtaatgactggcttagcaatggatgtgccagttgttttcgctagaaagcataagagcttgacccttactgatgatttatacacagcgtcagtttactcatatacaaagcaaactagtaatcaaatctctatttcaaaacggtttattgatgaaaaagatcgagttttgattattgatgattttttggctaatggccaagcggtttccggattgcttgatattgcggatgcagctaatatcgatgtagtgggagtcggaattgtgattgaaaagactttccaaaagggaagccaaattattaaagaccgcgacattcagttagaatctttagcaagaattaaggcgctaacggatgatggtcaagttgaatttgaataaataagtaagaagattgatgaacaggcgggatgatttaagtggagagtgaagtaattacctctagaaaaattatttatccaggggacataattggtattattggagaaggacgttcaagtgtacaactcgttgctactgcaaagtcaatgggttttaaggttgctacatacgttacttctgagaaaaatggcgtgaatcaatatgcggacattagttttgtcggtagtattcatgatggggaaaaattacaacgctttgcagaacgttgtaaaattgttctatacgaatcagaactaattgatattaaaacaattcaatatttacaacaatttgtttcaattccacaaggagttaaattacttgaattaaatcaagatcgaatcctagaacgagcaactctagaacaaacagggattaagggaacaccctatgttacagttgtagatttagacgatttatatgagtcaattaatgaaattggatatccggctattcttcgtccaatcttaaaggatactatgactgaaaaagagttaattcttaagagtgagatagatattccaaaggccagcgtactattagaacgtggaacttatatgcttcaaccagttatgaccggtggaaaagaaatcgcagtaagtattgttaaagatcaaaataatcgacaaaaaatgtttccaatggtcgagaatgtttacgaaaaccattttctaaaagaaactaaagttccagttgatttagattcaaaagttcaaaattcagtattagaagcagcaactaaaattgctggtttagtagagtacgtaggtgtattttcaatcgtcttctatgttgatggtgaggacatctattttgaacaattaatacctggaattcgtgatgaacaaaacgtatttaatctagcgtcaaacaccacggtctatgaagaaatgctccgggccttgagtggaatgatgattagtgacatccggctccaagtaccaaccatcatgttaaacattacggatgaacaaatgaagaaaatcaaaacacagtggttaattaaatcaaattggcatttccacttctatccacaagtagatgaagcagatgctaaacagcatatcggatatatcttggcagatggtgatgatgttaaacaaattcaagaacaaattgataacactgatatttggtaaaactctgttaaagtcggtaaataaaccggctttttttgatataatggtttgtggttattttttagttacgtagatagagaggattgaacaaattgccagaaattaatttaataaagggccttaatgatatgcaaaaagaagcggttcagacaactgaaggaccgttattgattatggccggcgccggtagtggtaagacccgagttttgacgcaccgcgttgcatatctaatagaagaaaaaggtgttaatccgtggaatgttttggcaattaccttcactaataaggctgctagagagatgcgtgagcgagttactagtttgctgggtgatgaagctgctgaaatttgggtatcaacgttccatgctctttgcgtaagaattttaagaagaaatattgatcaacttggatacaatcgagcattttcgattgccgatcctagcgaacaaagaacactagttaaacatattttagccgatttaaattatgatcctaaaaagtttgatccacgttcagttttaggaacgatttccaatgctaaaaatgatttaaaaacgccactcacttatcgtgagaatgcaagtactccatatgaacaggtagttgcagatatctatgaagaatatcagcgtcgcttagagaacaatcaggctttagattttgatgatttaattatgaaaaccatcgaacttttccaaaagaatcctgaaaccttatcattttatcaaaataaatttcattatattcatgtggatgaatatcaggatactaatcaggctcaatatcaattagtaacgatgctagctaaacattttagaaatatctgtgtagttggtgattctgatcaaagtatttatggttggcggggcgccgatatgcaaaacatcatgaactttgaatcagattatccagattcaaagactgtaatgttggaacaaaactatcgttcaacccaaaatattttaaatgctgctaatgatgtgattgaaaataatgtagaacgtaaacctaaacaactttggactgataatgatgaaggtgaaaaaatttcatattatcgtggccagacggggattgatgaagctcatttcatcgttcaaaaaattcgtgagcaaattaaagagcataatttaaattacggagattttgccattctttaccggacgaatgcacagtcacgagtaattgaagatacgtttgttaaatccaacatcccttacttaatggtcgggggacataaattctacgatcgtaaggaaattagagatgtactgagttaccttactttgattgctaacgaagacgattcgatgagttttgaacgagtgatcaatgaacctaaacgtgggattggttcgacttctattgctaaattacaagctttcgcggatgaaaataattggtccttattgaaagcggctcgtagtgttcagattgcaaatggaatttctagtcgagctcgcaatgcaattgaagatttcgctaagatgattgacgctctacgtaaatcaggtgaatttttaaatatcacagaattaacagaagcagtcttggaacaaactggttatcgagctgctttagaaaaatctagaacgatggaatcagaagcacgccttgaaaatattgacgaatttttaacagttactaagcaatttgacgataagaatgaagctgagggaaatgaaattgctgacgaaaatggtgataacattcaattagtagatttcctagcggatttggccttagtttctgatcaagataatgtggaagaagaaccatcaggagtaaccctcatgaccctgcatgcggctaagggtcttgaatttccaatcgtatttttagttgggatggaagatggaatttttccactttctagagcaatgatggaccaagaacaattggaagaagaacgacgattagcctatgttggaatcacccgagcacgtcaaaagttgtatattacgaatgcttattctagaatgctttatggtaggacacaaactaatccagcttcacggttcatttcagaaattggatcacaatacttgaagagtgaaaatgaagaaaagagcttttcaagaaatactaaagaaaaatcatatccgtttgacaataaccgaaatgcacgcgcaacagctagtgtttatggtaatacccatgctacggcggttaaatctaatggtagcggagctggtaaagttagctggaatgctggggataaagtcgaacataaagcttggggtattggtaccgtagtgaaggtgtctggcgctggagaagatgccgaattggatatcgcctttaaagatcagggaattaagcggttattggccgcttttgcaccaattaaacgggttgtggaataaagaattttatacagggtttaggttagcgatataattagggataaatgaaagattgaggaaacttttctatgaatgtaactaaaaaattgagtttattagttgccacattagttatgggcgtgggactgactgcctgtggaagtttagataattcatcaatgcaatcttctaccaataatgtgaccggaaaaaagaacaaaaaaaataattaccaaacaacaggatcagcttcaggttcgtatgctggggtgattaaaaatggaaaatacgtgacaagcaagtcacggggattaactgccgatcaaaatggtaatgttaataacaccaagagtttcgagagtggattacaagacatttccaaaaagatttttccaacctctcaatatgttttccaagaaggtcaatatctgagttcagatactgttcaaaattggcttgatcgcgaatctaagagcaatccggaagggctgaaccctaagaataatggttcaaaagatccagacaaacgaaacccaatttatctccaggctcttgaagaacaggattatatggaaaaatcaggaacttctttgaaactcaaaggggttacaattggattagcgatgaattcggttgattattatcaaaaagaacaatacggcgctcaatatgagactaaaatctcagatgccgagattaaggctaagagtcaagaaattgctcaaaaagtgctagaacgacttcgcaagaaatctgaatttaaaaatgttccaattgtgattgcagtctataaacaagcttccaatgatagcctagttggtggaacatttatgcgttattctaacaattccggtgaaaagcttgcaaaatggaaagacttagactacaagaatgttgtttatccaattagtgatacggaaacctcacctaatagcaatgattctagtgcgtttgataactttaagacgcaagtagaaagcttcttccctaatttaagtgggattactgcaaaagcaagatacgacggtaaatcgatggaaggcatgagtgtatcaatcacgactcaattctatagtgagactgagattaacagttttactcaatttgtttcaactcaggctgaaaagtatcttcctagtggagttaatattgatataacaattaaatctaccgatgaagtccatagtttcttatcgcgctcagctaaagaaaagacgtttagttcccatgtcttttcaagttattaaatcttagaaggagaaatcaatgacaactgaaaataacattactaaaaaagatgtagaacatgttgctacgttagctaaactaaaatttaatgacgaacaacttgaaaaatttacggatcaaatcgaagatattatcgatttagtggatactttaaatgaggttgacacaaccaatgtcgaacctacttttaatgttactgatcaattaaatcgaatgcgtgaagatgtagctgttcgttcaaatgataaggaagcattattagctaatgcccctgaaacagaaaacggatttatccgtgtaccagcaattcttgatgaaagtggggaagcataatgaagttttttgacataacagtaacagagcttcatcaaaagttagttgataaggaattaacagtaactgaattagtttcagaaacattggatcaaattgaagccgaccaaaaagttttaaatgattttgtaactattaatcgcgagagagctctagctcaagcccgtgctatcgatgaaaagggaattaaccctgataatatttgggcgggaatcccgattgctatcaaagacaatattgtaaccaaagggatcaaaactactgctgcatctaagatgctcagtaacttcacacccatctacgatgcaactgttattgaacgtttacaagctaatgatgtagttattattggtaagacaaatatggatgaatttgccatgggtggatcaactgaaacttcatactttggtgatacgcgtaatccatgggatcatactaaggttcctggtggttcatcaggtggttctgctacaacagtttcagctgggaattcaattgctgctcttggttcagacacgggtggctcaattcgtcaaccagcctcatacactggaattgttggggtaaaaccaacttatggacgtatctcacgttatggtttaattgcttttggatcaagtttagatcaaattggacccatgacgcgtacggttaaggataatgcagctttattgaatattattgctggaatggatgagcgcgatttaactagttctgacaaaaaggtaccagacttcacatctaagattggtaaagatattaaggggatgaagattggtttgcctaaggaatatctaggcgatggaatcaatgaagacgttaaaaaagtcgtacgtcaggcagttgaaacattaaccaatttgggagcaacgattgaagaaatttcgctcccacggagtaagtacggtgtagcagcttattatattatcggttcttcagaagcttcatctaacttacaacgcttcgatggtattagatatggtcatcgagctcaaaatgtcaaaaatcttgaagatgtatatgttaaatcacgttccgaaggtttcggagatgaagtaaagcgtcgtatcatgttagggacttattcgttatcggctggtacatatgatgcatactttaagaaggcagcccaagttcgtactttaattattaatgatttcaataaaatctttgaagattatgatttgattattggaccaacagctccaacaccagcctacgctataggcgctgaagttgatgatccaactacaatgtatatgaatgatgttttaacaatcccagttaacttagcaggtttaccagcaatgtcagttcctgctggatttagtgataatatgccagtcggattacaaattattgctaaaccgtttgatgaagaaacgatgtatcaagctggggcagcttttgaagctgcgaccgaggtacattcaaagcaccctgaaatggaggacaaataatgaattttaaaacaactattgggcttgaagtccacattgaattaaaaacaaactcgaaaatttttagtccttcacccgttgaatttggtgaccaacctaatgctaatacgaacgtaattgactgggggtacccgggagtattacctcaaactaacaagggtgtggttgaggcagggatgatggctgccaaagctttacatgctaatattactagaactcaacatttcgatcgtaaaaattatttttatcctgataatcctaaggcttatcaagttacccaagcggatactccaattggtacggatggttggattgaaattgaagtagaaggtaaaaagaaaaaagtcggtattgctgagatgcatattgaagaagatgccggtaaaaatagtcataatcctaatggatactcttatgttgatttgaatcgtcagggtactccgttaattgaaattgtttctaaaccagatatcgaatcaccagatgaagcttatgcatatcttgaagcgttgcgtcaacgaattcaatttactggtatttcagatgttaagatggaagaaggatccatgcgagtcgacgttaatatttctattagaccactgggttctgaaaaatttggtacaaaagctgaattgaagaatattaattcctttaactttgttcgtaagggacttgcttttgaagaaaaacgtcaacaaaaaattctgttagctggtggacaagttcgtcctgaaacgcgtcgttatgatgaagctacggggcaaactattttgatgcgtgtcaaagaaggggcagaagattatcgttatttcccagaaccggatcttccaagcattaccattgatgatgaatggatcaaagacgttgaagataagatgccagaaatgcctggtaagcgtcgtgctcgttacgttgaagaacttggtttgacagattacgatgcgatggtcttaactcaaactaaggaaatgtcagatttctttgaagctactgttgctcaaggagctgatcctaaattaacggccaactatttgatgggggatgttaatgcttacttgaatgatcaaaaagtcgatcttcaagaaaccaaattaactcctgaacacttggccagcatggttaaaatgattactgatgaaacgatttcttctaagatggctaagaaggtctttaaagccatcacccaaggtgaagaacctacaagttgggttaaagctaaaggtctggttcaactatcagacccagccgttttgaaaccaatgatcgtagaaatcgttgataataatgaacaatctgttgctgactttaagaatggtaaagatcgagcagtgggcttcttagtgggacaaattatgaaacaaactaaaggacaagctaaccctaaagtagttaacaaaatcctaatgcaagaacttaattctcgttagaggaatagaatcggaggatgacgtacgatgcggaaacgtgcgcgaattatatataacccaacttcaggacgtgaaatgattaaacaacacttagttgaaattcttgcggtaattgagaaagcaggatatgagacaagtgcttttgctactacacctgaacccgattctgccaaaaacgaggctcgccgagctgcaaaagatggatttgatttagtggttgcagctggcggagacggaacgattaatgaagtagtaaatggaattgcaccgttacttagacgtcctaaaatggcgattatcccgactggaacaaccaatgattatgcgcgggctttacgaattccacgcgaagatccagtgggtgctgccaaagttattttgcaaaatcaacgactaaagatggatattggtaaagctggcgaaaattatttcattaatattgcggccggtggtttattaacggaactaacttatgatgtgccttcaaaccttaaaagtatttttggctatcttgcatatattgttaagggggcagaattactcccacgggtaaaaccggttgaaatggacatcgaatatgatggagaacggtatcatggtaaagcttccatgtttttcctcgcgttgacgaattcaattggtggatttgaacaaattgtaccggatgcttctctggatgacggtaaatttacaatgattattgtaaaatcaggtaatttacctaacttactccatttaatggttaaagccttaaatggaaaacatgtcaatgattcgcgaatcatttatcggaaagcacgaaaagttacggtccgtccagtaaacgatcgtgttatggttaatttggatggggagtatggtggagatgctcctatggtatttaaaaatttaaaacgccatattgaaatgttcactaacttagatgatgtaccagttaatttgattaaagaagatgacgaatatcgacaagtggaacaacaattcgtcgaagaagttcaaaatcttccagatgataacaaaatagattaaagaaaagcttgagaaatacgctgaaatgcgttacagttcttgagtagcacacgagaataaaacaggctggtattaataatgtgccagcctgtttttatcagtaaatagataggggaaataaatgaagagtacagcacctgttgaaaaaaatttagtatatacggtagaaattgaagatttaacatatcaaggcatgggagttgctaagattgaacattttccaatttttatcgctgatagtattcctggtgaaaagattgaaactaagattattaaggttcaaaagaattttgcttttggacgtgtagaaaaggtcctagaagaaagtccagatcgtgtagaaagtaatgatgcggcttatacccaaactggaattgcgccattacaacacgtcacgtatgatgcacaactaaaattcaaacaaaatcaaattaaaaacttattgaaaaaatcacatctagaagatttagaagtggctgatacagttggaatggaaaatccaaccggttatcgtaacaaggctcaaattccagtacgtaaaattaaaggaaaacttcaaactggctttttcaagcgaaacagccatgatttagttcctatcgaagatttttatattcaagatccagtaattgataaggtaatcgttgaagtacgcgatattttacgcgaattttacattgatccatatcgtgaagcagaaaataagggaattattcgaaatattatggtccgtcgtggacgtcgttcaggacagattatggtagttttgattacgcgtactaaagatgttcctcatctagcagaaattacagaagcaattgctgctattgatggtgttgttagtgtaattcaaaatattaattacaaacaaactaacgtcattatgggagatgaagaccgggttcttgctggtgaatcagttattcatgatgaacttttaggactggatttcattatttcagctcattctttctatcaagttaaccctatccaaactgaaaaactttatcaacttgctatcgataaagctggattaactggagaagaaactgtgattgatgtttatagcggaatcggtacaatttcgcttgcgatggcaaaagctgctaaaaaagtttatggcgtagaaattgttaaggaagctgttcaagacgctaaaatcaacgctttccaaaataacgcaagtaatactgaatttgttgttggtaaagccgaagaacaaatgcaaaaatggcaagaagatggcttgaaaccggacgttgttgttgttgatcctccacgaaaaggacttgaccaaagtgttattgatgcaactgttggtatgaagccaaaacgggttgtttatgtaagctgtaaccctgcaacccttgtacgtgatattgatcgttttggagaacaaggctatgtagtaaatcaaccaatcgttcccgtggaccaatttccacaaacaccacatgtagaaagcgttacggtgttagaacgacaataattaattaaaacatattattactaacccagaatgattataatcgggagtaatgatatgttttttgtttacagagaaatttaatgataattgttaatgaaaggagctaatattgtgactttacaaagaaaagatataatcatgggatgtttatttggtggagcggcgggagatgcattaggttatccggttgaatttgatacttatgaacaaattcaacaccaatatgggaatacaggaatcaagtttgaaaattttactggtaagccattaatatcagacgatacgcaaatgacattgtttacagctagtggattgatagataaatctaattatttagagaatatctggttgaactatcaagactggctggagacgcaatttaaacctaataaggaaaatatgagccatgaaccagtttcattactaattaataactatcctgaaatttttgcgagtcgcgaacctgggggaacgtgtttacgagcgttaatgcgtggaatacgaggaacattggaagagccaattaatgatagtaaagggtgtggaggagtgatgcgagtagctccgattggattactcgatgatggctttagtgaccaataaattattcatttagctgcccaaagtgctgctttaacacatggacattcacttagtacgattgcttcagtttttatggcagatctaatacatcaaaatgttgctggagagaatcgattacgtcaggcaattcaaaatactaggattttgattcaagaaacattttgtgattattctgaaatttttacatttatggaaatgctggatagtacgttagggtttatcggtaatgatgaagaagatttaaccaatctaaaaatgattggtgaaggctgggtagcggaagaaacactaatgatagcaatatatgctacattgaaatatgagaacgatccagaaaaagcgattgaagttgcggtcaatcataggggtgattcagattcgacaggggctttgactggacaaattattggagcatttcatggaatacaatgtctaccacaaaactttattagcaaattagaattaaaagatgcaatcgtagaaataggtaatcgattggtgtgagagacgatttaatattttatggtaaataaaatcttgtgtttttaataattaagggtatactcctaattaaataccattggtatctaaggagagaatatgtcgcgaaataagtatccagaacaatcacgcgagaaaatattgtatgttgcacaaaaactttttttagaaaaaggatatgaacagacaactattcaaaaaattgtggatgatttgaatggaatgactaaaggagttatctatcaccactttaagtctaaaaaagatatttggaatgccgttacggcaagaatggctggtgattcaacacaacaacgttggtttgaaaattggccaggaaagacagggttagaaaaattacagagggcattgctgagatcattaagtgaatttcagagatatgatgttgcatattcagctgaagtaatgttgaaagatcctaaaacaattggtgaattatttttaaaaaatttagctgaaggaacggatggtatcgaggggtatgtaattgagggaatgcaagatggttcgattaaaaccgaagatgcacatgaattagcggaatttattattatttcgattaatctatggattggaattcgatttactagtttaaaaagagagcaaataaaaaataaatttgaactattaaaacgtgtttatgatgggattgatgtaccacttattactaatgaaattattgacatggcagttcgtttatacgataacttacaaattgtacaaaagaagttctaattgaatcttagaacttttttttaaaatttatacataccggtagtatgtaaagaggaatgaaatgaaaaaagttatttctaaaaaatatattaaaccattgttagtaggattattcttttcaaacatcgcaacgaactcggttcaatttattatctcgttgtatattttggatcaaacagggtcgacgagtttatttgctaatattatggcgattgcactgatttcaaaaataatatacactccgttgagtggaaatttaattgatagatattcaaaaaagatattgatggttgtattggatagtatgtacctgatatgtacattaatcttgattttggcagttcatcactctgcaatatgttcagttttgatatataacataataattggagcaatttcttcggcagagacaccgctcgtgcaagcgagtgttccattattggttgaaaagcaggatttgatggtaatgaatggattagtgagtcagatgacggttttaagtggaattttggcgccaatggtagcgggagtagcatatcaagtattttcatttactactatattacttttaagtagcttattttttattattgcgataatatcagaaattacactcaagattccaatgattgatcaggaaattaaatcgagtttagccaatttcaaaaatgtgctcacatttttagtaagcactggaaagaagactggtaaattagcactattagctggagtaattaattttatagtcacggcgtttgttgaagttgctgttcccgtgctttttcgcttgaaatatcatgttgcatcaaatatttttggattgattcaggcaggactggcgtttggaatattattggcagcgatgctaactccgttaattgttaaaaagataaaattgaataatgtatatacaatgtaaatataaattaagagatatatgaggaaatgagggaacgtcatgaaaattggattgattggtttaggaaaaatgggactcaatttagcggaaaatatgttagataataatatcgaagtattggcttttgatgtctttgacaaagctagagagaatgctgaaaagcataacataaatactgtagatagtattgaacagctagttaaacaacttgatcaaccgcgaataatttggataatggtaccagccggagctcccactaacgacactatcggccaattaagcaatttattaagcaaaaatgatgttgtgattgatggaggaaatacatattatcaagattcacttcatcataatcaggtacttagtaaagctgggatttatttcttcgatgtaggaacatctggagggatgtccggagcccgccatggaggtaattttatgattggcggagataaagacaagtttggggagattgaaccattatttaaagctattgctgaaaaagatggatatctttatacaggccaagctggttcagggcattatttaaaaatggtccacaatggaatcgaatatggaatgatgcaagcgattggtgaaggatttgaagtactttctaaaagtgcatttgattatgataatgaagccgttgccaaagtatggaaccatggatcggttgtccgaagttggttgatggaactcgcacaatcagcctttagtaacgatcctaacttggatgaaataaaaggggttatgcatagttctggagagggtgcttggacggtcgaagaggcgataaggttacatgtcccaacccctgtaatcagtagttcgttgatgatgcgttatcgttctgaagaagatgatacgatgacaggaaaagtagtatctgccttaagaaatggttttggcggacataaagttgatcataaagaatagttgaggtacagaatatggattatatgattggtgttgatcttggcactactagtacaaaggtagttttatttgatatgaagggaaattcaattgcctatgcaaacaatccttatcctttatatcaggatagtccagatatggccgaggaagatccagccgaaatttttgaagcagttattaatggattaactgaagtgatgcgtaagggaaatgttaagaatggtgaattaaagggagtatcattctcaagtgcgatgcatagtttgattttgatggataaagataatcatccattaactagagttataacttgggcagataactgttcgagcaagtatgctgaagaattaaaggacaatggacttggccaacaattatacgcccatactggtgtacccactcatccaatgtcaccattagttaaattgatttggttaaagaatgaacaaccagaaatttttaaaaaggcgactcattttattggtattaaggattatgttttatttcgattatatggaaagtatgttcaggactactctcttgctaacgcgactggactatttaacattttcacgatggattgggatgaacaagcccttgaaattacgggtgtaacgcgagaccagcttccagaattagtttcccctgaatatcaattaacggggttagctaaatcgtatgcggaggtgactgggattccggaagatactccgttcatcatgggagctagtgatggtacccttagtaatctaggggttaatgcaattgaaccaggagttttggcggtaacaattggaacttctggagcagtacgcgtggttgtggataagccagttgttgacccacggggtcgattattcacatattacttggatgatggtaagtgggtagtaggcggaccggtcaataatggtggaattgtatttcgctgggttcgcgatcaattattctctcctgaaaaaattacggctgaacaaatgcaagtcaattcttatgaaattttaaccgacattgcttctaagattccagctggcgcagatggactattgtttcacccatatttaggcggagaaagagcgccgatttgggatgcaaacgcacgtggaagtttcttcggattaacgcgtcaacatactcgtgcacacatggttagagcagctttggaaggcattgtatataacctttacatggtaatgctaatgattgaaggagtagccggtaaaccgaaatcaattcaagccaccggtggatttgctaggagcgcactttggcgtcaaatgttagctgacatttttgaacaagatgttaatattccagaaagttttgaaagctcagcgctgggggccgtggtgatagggatgaagagtttgggaattgtcgacgatttgcgcgttgttaaggatatggttggggtaacaaatacacataaacccaatcaagagaattttgcttcctatcgagaattgctaccaatttggattagattaacagatgaattatctggagaatacgatagtattgcaaaatttcaaagaaatcatcctaatgaacatgcaaaaatagctgaagaagattaaagagacaatcaacggtctttttaatttaatagcaaaaagaaagcggttacttagatgggggcgtgttatttatggaaattatggtcttagttattggaataattttattgttaactttaattataaaatttaagatgaatacttatgtttcattgattattactgccgtggttgttggattaggtttagggatgccggctagccagattgctaccacgattcaaaatggaattgggagtcaattgggtgaactagcgttggtatttggctttggagctatgttgggtcgcttggttgccgacgcagggggagcctatcggattgctaataccttaatcgataaattcggacgccgcttcttacaaattgctgttgtagttgcttcgtttattattgggattgcacttttctttgaagtaggaatcgtgctattagtaccaattgtatttgcaattgcgattgaagcaggggttccagttctttccttaggaattccaatggcagcagccttatcagttactcacggatttttaccaccacatccagctcctactgcaattgctgcagtcctgaatgctaatgctggaaaggttttactttacggagtgattattgcaattccaactgtttatattgcaggtgtattattttcaaaaattgctaaaaaatatcttccagaagcgtttaaaagaaatggtaatttaaaagctttaggacctcaaaaacaatttaaattagaggaaactccgggattcggtatttcggttttaactgctcttttcccagtcatcttaatggctatcacaacgatctatgaattgattgtccacgacggtgttacacctaaaaatcctaatgcggttgacaatttttttggatttatcggttctcctagtatagctatgttaatttcattattgtttgcaatgtggtcgatgggttatcaccgtaagattgctagtaaagatattatggctactttagaagatgcggtgaaatcaattgcaatgctccttctggtaattggtggtggaggtgcgtttaaacaagttttaattgatggtggtgttggagatgcggtcaaaaatatctttgcatcatctagtatctctcctctaattttaggatggttgatagcggtagtccttcgagtggctttaggatccgcaacggtggcttccctaactgctgccggtttagtattacccttaatgcaaggggcgggaattgatccttcattaatggtgttatcagttggagcaggaagtttagctgcgagtcacgttaatgatgcaggcttctggatgttcaaagaatactttgatttatccgttaaagaaaccttactaacatggacagtactagaaacagtcatttcgattgttggattaattggcgtgttattattaagtttgattgtttaacttaaaggcattaaaatagctatctcaccacgtttcccgtaaactgtaagtgggaggtggattaaatgaaaagagctctttcaattattgcaatagtatttgttttcatagcaatctttttgggctttaggtattaccaagatacttaccaaagtagtgaagcttacactatgattccggaaaaagttccgcctaaggtacaaactaaagatgattcaggcaaagtaatcgttggtagctattcatataattataaatttaagtttgtgaccaaatctggtaaagaacaaactatgaagtatgaattaaatggagaaaacgtcaaaccctttaagccgggggcttatgccaaggctgagattagcaaaacgagaatcaacaagggacctaattatgtgaataagaatgaagttccatcaaaagcgttagaaaaattaaattaagacaataaaaaagaattttccatctaaaggaaaattctttttttgatttagattgtgtaacgtaatttagcaataaccttatcattaagtttatcttcgggaagaattcgaacgttaccactatttttaatagtgagatcggctaggtcactcagcaaattattgtgaatagctcgcgaactggttgtatcaactatttcattatctaaaatacgtccgtcaatccgaaccccctgggccaaatagatagtatcgacttgaccatgaattgctgacgtaataatttggtttaagtcggcagagattaatgctgcaccccgggccttatcaatctcatctaaatcttgttcaagcaaggctttattacgttcttgtttgaatcgttcaatccgatcttcaattttttgatcgtagtccagttcagtgggattgagatctaattcaaattcactgaagtgattaggcgttttattaacttctttgaataaagtcatattttgaggtaggcccattaaaattactggtttcgctggatcattaccaaaattatcaatgatatacttatcaacaatttggtagtaacggcgatggtcgatttctttttcagcagaagtgtcattgtggccatgaacactgatttttccattaccaacagagaccgaattagtttctccaccccgaatgtcgtcacctaaagccttttttaaagtcttgggtgcatcatctggtaacggtaattcttttaagtaacgatctgtaaaatcgtaaaggcgaattttatcgtagctaatccctaatagataaaattcaaagcgattttggtaatcaagtaacattggcaagataaatggtaaatcagtagccattgcaatatcatgggtttcaaccgttaattcttgaacaaaaatggtttttccgttggtgattaacccaaatgaatttatattattacccatattccaaagtgaagaactatcaacggttgaatcaattaattgtcgataatcatccccattatcaacatcccaagtggcttgtaaaacttctaaagcatgtttaacgagattctttagtgtaatagatgtcttttcaacgggctgattcggttcaatatccatataaacagaaataaaaggtcccttctgggtggagcgtaagaattctgttagagaagtatacttttgagtatcttgcatgttattacctccttcatattataccttcagtctaacaaccgttgaaaacggattcaaaaaatatgcctatttattaaaattgataagtcagtacaggtcgcttttttatgcgatacttggatatataaattattcttcataactcaattatagaaagaagtgttggatttgacggtggaatttgaaatagctttaaaagaagacttaccagaaattgtaaagatatataatgaaacaattgattcaaggatggcaactgctgatacaaaatatgtcacagttgaagaacgtcaggaatggtttcaagcgcatcaagaacctactcgcccgctttgggtaataaaagttaggggagtaatcgctggatggataagtttcagtagcttttatggaagaccagcttatctgcataccgtggaaattagtatttatattgatcagagttttaggggaatgcacttaggacgaaaagcaattaagtttgcggaggagcaggcacctaaattggaaattaatcgaattatggctttcatatttgcgcataatctacctagtattggtttatttaaatctgaaaattatgaaaaatggggaactctacctcagattgctgaaatagatggccaattgtacgatttaacaattatggggaagcatttaaaataataaaatttaaaaaagtcctagttttcaccgtttgaatttaagtcaaaaagaacttttttgcacaaatttggcataaaatgactgatttcataaataaatatttcatttaaagaaactttgggaattgatagaatccttttaaactagtgaataacgaggcttatattacagaatgttacaaagtcttacaaaatatcccattatccctgaaattacaaatatacctgtaatatacttcctgtaaagttatttcttgtcgaaaagaagcaaggatatgtttttttaaaataaaggagatatttatctatatgtcatttaagagtaaattttcaaaactttctatcgcattactatcaggtgccgcaattggtgccgcaatgattacaacaggcggtagcgcaaatgccgacgaaatttacacagtaaaatctggtgatactctctcagaaattagttacgcattcaacttgaatggtgactacaattcaattgctaaagcaaataacattaaaaacgttgatgttatcaatgtaggacaaaagttagttattactaatggtggggacatcaagaaagctactaaatcagaagttaaatcacttccagaagtagctaagaatactaacgctgccaatgcagctactacgagcacaacaaataatacaactacaactaacaatgctgcttcaactcaaacaacagctaaatcaagctatgttgctccagctcaaagtagcacaacaacaagcagttcaaatggcggatcagtagctcaacaaatggctgctaagaccggtgtttcagctgctacatggcaacggattatcaaccgtgaatctggtggtaatgctaatgctgtaaatgcttcatcaggggcatacggttatttccaactattaggtcatggtgaacatgctggcatgtcaacttcagaacaagttaacatggctgctagtgtatataaagctcaaggtatgtctgcttggggtgaataagcaaaagtaacgtctttatagacacttttgtgacagaggaaagttttctttcccctgttttttattaaaaacgtcctaaaatataaggttttttagaagaaatatttcattttgaattatttcataaaaacatgaatgcctttatatcaacgtttatgcagcataatattacagaatattacttctttttacaaaaaaacgggatatttatagatatccaaaatatatttgtaacaaacgtcctgtaaagtaattacctgttaagaagaaaacataaaaattaaaaaaatgatttaaaacacaaggagatatttctacatgtcaattaaagctaaactttcaaaactttctatcgcattactttctggagcagctcttggagcagccatgattacaactacaagtagtagtgcaaatgctgatgaaatttacacagtaaaatctggtgatactctttcagaaattagttatgcatttggcttaaatggtgactacaactctcttgcaaaagcaaataatattaaagatgcaaatattattgaagttggtcaaaagctggttatcacaaattctggtgatatcaagaaagctacaaaatcagaagttaacactcttccagaagtagctaagaacacaaatgctgcaaacacaacaacagcaaatacaactgcaagcacaacaacaaataagacaaacacaacaactgttgctaagacaaatacagttgcaacatcaacaccaactacaacgactacaacatcaactgtttctggtggtgaagcttcagctaaagcatggattgctaacaaggaatctggtggttcatactcagctacaaatggacaatatgttggtaaataccaattgtcatcttcatacctaaatggtgattactcagctgctaaccaagaacgtgttgctgataactacgttaagagtcgttacggtagctggtcagctgctaagtcagcttggctatcacaaggttggtactaaaattaggtaattaaattctaaaatttataaaagagggacaaactaattaagtttgtctcttttttttgatattatattcacatttttttcgataaaaaaggctatactggataaggtaaaaggaactggaggagttttgaaatgcgtatattgatgattgaagataataaatctgtttccgatatgatgggaatgttttttaaaaaagaaagatggaacgttacatttgtgtatgatggattaaaagccattgaaacttttaaaaccgatcctgaacaatgggacatcgttttacttgatttaaatttacctggaaaagatggtatggaggtagcagctgaacttcgacgcacgtcgcagtccatccccttaattatgttgacagcacgtgattcagaaagtgatcaagttttaggcttagaaatgggagccgatgaatatattactaaaccatttagtcctattacgttaatcgctcgtattaaggccttgtaccgacgagtgtcaatgagtagggaaacgatgacgcaaggtgctcagaatgcgaaattcgatgttagaacagcccatcttaagataagtacatctactcgagaggtatatttagacgaaaagcttatttcagatttaacccctaaagaattcgatttacttaaaacattggcgcagaagcccatgcaggtcttctcacgagaacaacttctacaaatagtgtgggattatgaatattatggtgatgaacgtacggtagatgcccatattaaaaagcttcgccaaaaattagaagcagttggtccacaagtggtccaaacggtatggggagttggctataagtttgatgatagtaaaatcgatgaggattagttaatatgaaattgttttttcaacagatgatggcctttttattagtaactctgtcatctttattgatcgttggattggtttttattcagtttactaaagactcagtttaccgcaacaaatggcattccttgcaagaatatgctgatagtatttttcagcaagcaattgtgttagatacagaaactgctgatgtaaagagtgtacaagttgatcagcttcaaggtgtggaaaaactgttagataatcaacacattcactttacaatctacactaatgatggaaatacgattagttatccaaaccgtaatatagcttctcgaattactaaagctcagcgaagagaattgaaaaatggtgacacggtcaaaaccaaatcacgcatgacttttgataagtcaagtcgacaagttaccatgacagagatggataagccttattttaatcgtaatggtaatctggtttgcgtgatttcgattggatcaccattagctaacgtacaggctgacatcgagaaggttaaaaagaatcttttcatgacgtttgcctttgcgattattgtagcagtgattgcttcatatttcttatcacgttacttagtaaggcgaatccaagcaattcgagaagctgcgcacaaggttacggaaggaaactttaatgttcagttagtttctgggcgtaaggatgaaattggagaattgaccaacgattttaatattatgaccgcttccttgaaagagtctaatgatgaaataaaacgccaagaagaacggcgacgagcctttatggctgatgcagctcatgaaatgagaacgccattgacaaccatcaacggtattttagaggggcttgagtatgatgcaattcctgaagatagtaaagaggaaagcgttcatttaatgcaacgagagacgaagcggcttattcggttagttaatgataatttggattatgaacggttgcgcacgaataaaattagtttaaatcgtcatcagattaatctaaagcaagcaactcaaaggattagtaaacaactagctaaaaaggccaaacttgaaaatgatgtgattattattgatatggctgatgatgtgatggtatacgctgatacagatcgcttaattcaaatcttatttaacattattcaaaatggaattcaattcactcaaaatggaaaaattactattcgggcccaaaatgctaaagatggtactgatatccaaattagcgataatggaattggtatgacagaagagcagatcaaaaatatctgggaaagatactataaggctgatgcatcaagaattcaaaccaaaggtgaatctggattggggatggcaattgtccatgaattaatgcaagttcatggaggacaaattactgtcgagagtactccagaaaaaggaacaacttttaaattacattttccagagcaacaaaaaaagcttggccattaagccaagcttttttcatggatcatcttaccacattgatggtgtgttgaaccattcgatacgttccttaacagtgttcttgatagcttctgtacctgaagcaagaactttacgaggatcgaatcctttagctttcttgtcattgtctgcttcgtagtatttacgaacagcgtttgaccaagcaatttgttgttctgtgttaacgttaaccttagaaatacccattgaaatagccttaacgatttgttccttaggaattcctgaaccaccatgaagtacaagtggtgtcttaataacatcagcaagttcttgtagacggtcaaagtttaaaccagtccagttagcagggtatacaccatggatgttaccaataccaacagcaaggaagtcaacgcctgtagcagcaagttgtttagcttcttcaacatcagctaattcaccagcaccaacgataccgtcttcttcaccaccaattgagccaacttcagcttcaactgatacgccttgagcatgtgccaaagcaacgatttcttttgtctttagaaggttatcttcaaagtcaagatcatgaccatcaaacataactgaactgtatccagcagcgatagcttctttagcagcttcgtagttaccatggtctaaatgcatgataacaggaactgtgatacccattgattctacttgtttttcaacgaggttcttaacagctttgtaaccacccatgtacttagcagcacccattgatgattggatcaagataggtgtgtgtgtttcttggcctgcagctaagatagcacgagtccattcaaggttgtttgtgttaaaagcacctacagcgtatccacccttacgagctgctgcaaatgttgatgtaccattaataaatgacataaaactggttcctcccaatattgtttatacaaacaaagagcttttctcttcgcaacacatctattttatcacaaaattaaaaaatattatacgagtttttcagaaacaagttaacatatggacgtttttaattaaaaaattagtatggtccaattttttattgaaaagtaatgaaaagccacataatacggcatttttagaatttattttacatggaataaagtatataccattttatatttacaaaataaaagttggaattcgctttcataactggtaaaatgatactttgtcttagagagagagacatatatttttagatatatatataggagagaattgaatatgagtattttaatcgcgttagttcccgcaatcatgtggggaagtattggattagttagcggtcgattaggtggaagcgcttctcaacaaacgcttggaatgacaatgggtgcggttgtcttttctttaatcactttagttctttaccatcctactttgaatggtaaaatttggattgctggtttgatttcaggtttattttgggctgtaggtcaatttaatcaatttagttcgatgaaacatattggtgtttcaaagacggttccaatttcaactggattacaattggctggtaacgccttagccggggtattaatctggcatgagtggacttctggtaatatgattatggttggtacaattgctgtcattgctttgattattggtgcagcactaacttcacttaaagataaaagtgacacaactgcagatcgaaatgacgaaaatatgccagctggaattcgcgctttggttgtttcaactattggttatatcggatatacagtaattgttcgttttgctaatgttgacgccaaagccattatcttccctcaagcaattgggatgttaattggtgctttaatttttgttctaatcgctaaagaacaaaaggaaattactaagaaaccaacttttatgaatattattactggtttgatttggggaacaggtaacatctttatgttccttgcaattccatcagttggattggcaattagttattcacttgctcaagctgggattgttatttcaacttttggttcaatttggttacttggcgaacacaagacgcgtcgtgaaatgcaatttatcatcatcggttcaattttaatcattgttggtgaaactttgctagcaacgctaaaataattttaaataaaagcaatactatagtaggaaaaatcgttttcgaggttgttaggtgacctgggaagcgatttttttcgtatttattagaaccgatggagtcgaaagtgggaatggcaatctaactaaatgaagatagttaaaaaacatcttaactaaaaagcgtaaattgttaatctgcgatacccttagtagttaaattttagtaaatattaggttaaatcggataggcttaaccaaattaagtaattttattgtataatggtacagataaagaattttaaacaaaaggggtagttattaatggcacatatttcatttgacagttctaatgttgcagattttgtacatgaaaacgaacttgcagaaatccaaccacttgttacagctgctgatcagattttacgtgatggctctggcgctggtagtgatttccgtggatggatcgatttaccatcaaattatgataaggacgaatttgcccgtatcaagaaagccgctgataagatccgcaatgactcagaagtattcgttgctatcggtattggtggttcatatttgggtgctcgtgcagccattgatttcttgaacaacactttctacaatcttcttaccaaagaacaacgtaatggtgctcctcaagtaatcttcgctggtaactcaattagttcaacttaccttgctgacgtattgaacttaatcggggaccgtgacttctcaattaacgtaatttctaagtcaggtacaactacagaaccagctattgcattccgtgttcttaaagaaaaactaatcaagaagtacggtgaagaagaagctaagaaacgtatctatgcaacaactgaccgtgctaaaggtgccctaaagacagaagctgatgcagaaaactatgaagaattcgtagttcctgatgacattggtggtcgtttctctgttctttcagctgttggtttattaccaatcgcggttgccggtggcgacattgaccaattgatgaagggtgctgaagatgcaagcaacgaatacaaggatgctgatgttacaaagaacgaagcatacaagtacgctgctttacgtaacatcctttaccgtaagggctacacaacagaacttcttgaaaactacgaaccaacacttcaatacttcggcgaatggtggaagcaattgatgggtgaatcagaaggtaaagatcaaaagggtatctacccatcttctgctaacttctcaactgacttacattcactaggacaatacatccaagaaggtcgtcgcaatttgatggaaacagttatcaatgttgaaaagcctaaccatgacatcgacattcctaaggctgaccaagaccttgatggattacgttatcttgaaggtcgcacaatggacgaagttaacaaaaaagcttaccaaggtgtaacccttgctcataacgacggtggtgttccagttatgacggttaacattcctgatcaaacagcttacacattaggctacatgatttacttcttcgaagcagctgttgctgtatctggttacttgaacggaattaatccattcaaccaaccaggtgttgaagcatacaagtcaaatatgtttgcattacttggtaaaccaggttatgaagataagacagctgaattaaacgctcgtctataaaaaactgaagtactactcagaagctatcacacttgtgatagctttttttattgaaaataatttccgaactacaaaagaaatcgttttctaggtaaggtataatattagatataaatatatcaagaaaagggaggcggacgaatggagttagttaataaacagcatcatgctttaggaacggtaattaatctttcaatagcctccatctatcaagttgatatcttagaaaaaactataaaaatgattgatgatttcgaagaccgtttaacagttaatcgatcatcttcggaagtgatggagattaaccatcaagctggaaaacaagctgttcaagtttcggaaacaacgtatcgcttgattgaaaaggcggtagaagttagtagatggcaattaggttttaacgtggccattgggccgctagtcaaattgtggaaaattggatttgatggggcgaataaacctagtcatgctcaaattttagaacggataaaattaattgacccgcaagcaattgttttgaatacccaaaatcgaagtgttttccttaaaaaagagggaatgaaattagatttagggggaattgcgaaaggatttattgctgatgaaattaagacatattggcaaagcaagcacgtagcgtcaggaattattgatttgggcggtaatgtgttgttagtggggcggagtcagcatcccgatgaaaaatggaaagttgggattcaaaatccgattaaatcaaggcacgtcccgttgggagttctacatattccagaaaagtctgttggcacatcaggcatttatgaacggaaattaatagttgaagggcagacataccatcacatgtttgattcagcgacgggatatccaattgttaataatttagctagcgtgtccatagtaagcgatcgttcgattgatggagaaatttggtcaaccatttgtttttatcaaggaattgaaaagggcaaagcgctactggccaatcaaccaggaattgaagcagtgtttattacacgggatttgaaagttcatgtaaccgatggactacagaattgtttcaatgaaatcgcgaataatagttaatccatatttttacatatagaatggggaatatttatgaaaaaatttgttgctatcggtggaacgaatagtaaaaaatcaaccaaccgtaaattactacagtacatgcaaaaaagatataaaaatgacgcagaaattaagctcgttgaggtggcgggactgccaatttttaaaaagaccaaggaaatggcgattccaaaacaagctcaaggaattgctcacgagcttgagaatgctgacggagtgattattggtactccggagtatgatcattccgttccggccatcttgcttagtacattagcatggctatcttatggaatccatcctctgctagataagccggtgatgattacgggagcttcatatggtgctttaggggcatcacgagctcaggctcaacttagacaaatactagattcaccagaaattaaagcgcggattatgcctagctctgaatttttactggctaattcgcttaaagcttttgattcagtgggaaatttaatcgatcaagaacaagttgaaagattagacggtttatttgaagactttattttattctcagatatttccaaacagttaaaccacgctaattctaataacgcaaaggaaatgcaaaacttttcatgggacgaaggttctggtagaagggatgaagaaaaatgaaactagtagcaattgcgggatctataggtgagcaatcttataatcgaatgttattacaatacattgccaagcattttgaaaacttagttgatattgaacttttaaatattgatgatgttccagttttcaatgaagatgaagatttaagtgataatattgaaattcaaaaaatatatcaaaaagtttatggagccgacggggttatcttagctaccccagaacataatcacacagtaacagctgcaattaaaaatgtcatcgaatggttatcctttaaattacatccctttgatggcaagccggtttggattgttggagcttcttatttcaaccaaggttcctcaagagcgcaactccatctaaaacagatcctcgaagctccaggagttaatgcaattgtaatgcctggtaatgaatttctacttcggaacgctaaggaagcgttcgatgcagaaggtcaattaaaggatactggtactgttcagtttttagaaatggtcatccagaaatttattaaatttgtgaaggtaattgatatgttagatgctcctgatccaaagtcttaccaagacgaagatcttgaatctaaaggtaaagtaaatacaactatcgaaggggtcgatatgcacgacgagcattgggttgaaaaagcagcccaaaaagttcacgcggtggatggaagtacttatgttaaattggatcgtggaattctaacggttgaccagcttaattatttcttgaagaccatgccagtggaacttacgtatgcagatgataacaatcagtttatttactacaacaaaaatcaaccggctgacaagatgctagcaccaagaaatcctgggcaagctggtgatccgttagcagacgttcatccagggcgagcagttgaccgagttaaacaggtgattcatgcgcttcgtaccggagaaactgatctagtttcgatgccagttccaggtaatggtccggatcgacatgttatgcattactataaagcaatgcgtgatgaaaatggtcgctatcgaggggttaatgaatgggtaactgatatcatgcccatcattaaatattatttagcatccactggccaaaaactaataaaggatccagcagccaaaccaatttcaccaattacagggattgacgtaatggctggtgcttcagctaagccagagcctgatgtaacttcaggagcttcggaagaggagcctgaaggtcttgatgtcacaagcggagcttcagaaacacctgagagcaatccagaagtagatgctacttcgggggcttcagaagtttaaatgattatataaaatgattccttgataataagggatcatttttttattgacagaagtaatatctaagactacactttaaccataatatatcaatgatattgttttgatatcacgaaaggagttaagatgggcaacaaagatcatgaaaaacgttttttgcttcgtttagatcaaaaactttatgaaaaacttcaatcggaagcggatgaacaaggacgaagcgttaatgcacatatcgttaatatcttaaatagaactaacacgccagcgacctttgagaaacgccaaattattggaaaagtcattgcaggtaaagatttaagtcagagtggactagtattagtttcaggaatttattacagatatttacttgatgataatggtaatgtggtcgaagacgcccaatatgccatcattgaagcaaatggaaatatcttaactttaagaagaatatagggggaatatttgatgttaggtattaaaatcgttccgcaaaataaccagggcttagttgagacgttaggaaagtatagtcatagtgtagaatcagggctaaatttttatattccaattttccaaaaaattcgaaagattagtttggcgatgcgacctttagcgcttcctaattattcaatcattactaaggataatgctgatgtttctgctagtttaactttgaattaccatgtaacggatgcagctaagtatcaatatgaaaatacagactcagttgaatcaatggctcaattagttcgaggtcacttacgcgatattattgggcggatggacttgaacgaagcacttggttcaacggctaaaattaatcaagaattagccttggcaattggcgacttaactaatacatatggaattaatgtcgaccgcattaacattgatgaattaacaccatcgagggcgattcaagaagcaatggataaacaattaactgctgatcgtgaaagagttgctacaattgctagggcagagggagaagcccgttcgattgaattaactaccaaagctaaaaatgatgctatcatggccactgctaaagctgaagcggacgcaactaaaacacgcgcagacgctgaacgttatcggattgatacagtccaaactgggttagctaatgcggatggaaagtacttcaaaaatcaatcgattgaagccttctccacacttgctaaatcagctgctaatctggtagtagttccatcggatggaatgacggaaataggcaatcttccagtggtaggaaaaatgttagaaaaagggatgaataaagcttaaaattttggcagacgattggatggtttgatcaagagtgatttcgaccgaaggttaatattcgtgattactgaaacctataaaaaatgagccgtgaaatatgataaaatgctccgataggtatttttatagatataggagagtaaactaatgattaattcgattgaaaatgatgatttttaccaaaagatgcaaaatgaaaaattaacggttttagatgtacgtgagaaagtagaatttatcgatggtcatgtaccgatggcacaaaattggcccttgagtgaattagccgaaaaatatagcaaattagatactagcacatcttaatgtgatttgtcgttcaggggcacgctcagcaaatgcatgtgctttcttgcaagataagggattgaacgttactaatgtaactggagggatgctagcttggaagggcgaagttatttagtagggataaaattaacaaaatgttaaatggaaagcaaaagagtcatgtagtgtgaaaactacatgactctttttaggttgattggccatactgggctcgaaccagtaaattacggattcagagtccgctgccttaccaatttggcgaatggccattaaaaaatcgcccgcacggggatcgaacccgtaactccggcttgagaggccgacgtcttaaccaatttgaccagcgggcaaattactctattaatttacactaaaaaatacgtttcgtcaataaagaccttaattaatttcaagaatttcaacctgatattgttcatcaggagcagtaactaggacaatatcatgggttttatggtgcataagtgctgaacctaagggagattggaaagagattttgttgttaaccacgtccgcctcatgttttcccacaatctcgtaggtgatttcgtcatggtcatcgacaaaacgcatcttgactatgcaacccaaatcgattttggaatgattagtgttttgaatgattttggaataactaatttgacgctgcaagtagcgtagtcggccttccatccgacgaaggtcacgtttggcggcactatattcggcattttcagaaagatcacccaaggctcgggcatcggcaagggccttgattaaggccggacgtgtctgctttaaatcatcaatttcttgattaattttagcgtagccactaggagtcataggtacaaactttggttgcataaaatcactcctttctacatggatgatgattcgaaagtaagttcaatcatatattcatgcttttcaaggatatgtgaggtggttacccagacagaatctagcccatgatttttatctaatgttttttgctggaaacgatcaagaatgtcactatttttagccacaaattcgtcagcaaatcgatcgactaataaagaattatctggaaaataaacatgtggttcagaaacgggaacggtgtccgggaaagtcatattaattacgtttctgtagccaatgtgatgaatcttaaccatctcgggtttattatcaattcggtacaaaatgttatataaagaatctgagttagttgccataaataagttcctttctacatgttgatattgtagcaaaaattcctaagtaaatgttgttgcaaatcgaaaaccaaagtgtataattgtggtttatgacaagttgtcatttttaggaggtcgaaatgccaaagcaaacattttttaatttaaaggacgaaaaacggcaacgtattatagatgcagctgaacgtgaatttagtcaatgtcctctatatgaatcttcgataaataatatcattaaggatgcgaaaattccacggggaagtttctaccaatactttgatgatttatcagatttatacgggtattattttagtttgattttagaagatattcaagagaatttgattgatagtgttcaagaggcggatggtgacattttttcagcagttaaaaaatatgctggggaatatatgaaagaaattatttcaggcaatcatcgtgatttttatagaaacttctttttaggagccaatatttcaaagcgttctaaagatggtaaacatcccgggtttgatgtatatcattcagatcgtatgaaagaactacgtgccaatcttaaaaaagaagtcaattggaaactcctaaaagtgactaacgaaaaggatcaaaatatgattcagcaattgataatgatgattttctttcattcttttgcaaattattttgtacattcaaacaacactgattcagatccggcagaagttcaaaaagaaattgaacggaacctcaactggttggaatttggtgcaagaagaacggaggataaatagttatgtggaaactactaaagtctcgatttacgtggtgggcggtattagttgggacagttttcttgatggttcaaattgcgggtgatttgcttttacctaatattacttcagatatcattaataatggtatcgccaaaaataacattggatacatttggaactcgggtttaaaaatgttattagtttcactagtaggattaattggtgcgggagttaacgtgttttttgctgcaactcaagcccaaaaagttggtaataaactacgcagtgatctcttcagaaaaatatcgttcatgtccaattatgaatttgaaaaatttggagaagcttcgttaattactcgtacaactaatgatgttattcaaattcaaaacgtgattgttatgattttacgcatgatgttaatgtcgccgattatgttagtcggagcaggatttatggcttatcaaaaacaatccgagttaaccgcagttttcttagttgcattaccattactggcagtttttgtgggaataattatgttttttgcggtccctttgtttaagggccttcagaaaaagattgaccggatcaacttggttttccgtgagggattaactggggtacgtgtcatccgagcattcaatcaagatcaatttgaacaagatcgttttgctgatgtaaaccatgattatatgaaaactggtattaaggtatttacaatcgtttctttcatgatcccggtaatgactcttttgatgagtggaactaatattggaatcgtttggtatggagctcatttaattgccaaccaaacgatgcaagttggtaatttggtagcctttatgacgtatgccactcaaattttaatgagttttatgatgctttcgatggtcttcgtaagtatcccgagagcttcagcttcggcagctcgtattaatgaagtattgaattctgaaaatagtgttaaagaccaagcaaacgtggaaaacatggttgaagattcgactgctacattggcttataacaatgttaaattcagatatcctggtgctgaacgtctttcaattgataacgctaattttgaagctaaggcgggagacaccgttgccgtaattggcggaaccgggtctggtaaaactactttgattagtttgttaccacgtttatttgatcccgaatctggttcaatcgaattgaatggcgttgatattaaaaagttaagccaattcaatctacatgaacaagtagcatttgcgcaacaaaaagcagttctctttaagggaacgattcgtgaaaatatgcgttatgggaatgaaaatgctactgacgaagagatttggcatgctttagaggtagcacaatcgacagaatttattaaacgtgatggcgatggactagatacttttgttgaacagaatggggataacttctcaggtggacaaaagcaacgtttatcaattgctagaacgttagtgaaaaaagctaaggtatatgtttttgatgattcgttttcagcccttgattttaagacagatgctaatttaagaaaagctcttcgtgaagatcccgaaattcaaaagagtattgttattatcgttgctcaacgaattgccacggttgctgatgcagatttaattctagtattagaaaatggaaaagtggtcgggcaaggaaagcatgcagaattaaaacaaacaagtaaaacttatcaagaaattatcgaatcacaaattaaggaaggagatcaagcaaatggctaaagcaaataatgcagcacgaccacaaaatgggcctcgccctggcggacatggcggtccccgtggtgtaatcgaaaagcccaagaatttttggaaatcagctggtcgattggtaaaatatctttcgccttggatgtttggtttcattgttgtccttatttttgcggcaatttctaccattcttcaaattcgagcccctaaaattttgggtgaagctacgactgaaatttttaaaggggtaatgaaaggtgcagctcagatgaagatgggtgtaccagtgcataaatttcctattgattttaccaagattgtcgaaatcttaacgtcagtgggactattgtatgtcctttcagctgcgtttagttttgttcaacaagtggtaatgacgcgcgtttctcaaaaagccgttgcacaacttcgagcagatttcaaaaataagatgcaaaaattaccgatttcttactatgatacccattcaaatggggatatcatgagtcggatgaccaatgatatggataatattagttcaactttacaacaaagtttgactcaattagtaactagtttcttccaatttgtcggggtattgtacatgatgctaacaattagttggaaactaaccctacttgctgttgcaacggtgccactgagtttgattgtcgttgcggttgtcgcacctaaatcacaaagattttttaaatctcaacaaaaacaccttggtttaatgaataatcaggttgaagaaacgtatgcgggacatacagtaatcaagacttttaatcatgaacaagatgcaattgaagattttgaaaaagaaaacgttaagtattataagtcagcttggaaagcgcaatttatcagtggattgattatgccattgatgaacttcgtcaaaaatattggttacttaatggttgctgtaattggtggtgtacaagttgcccacggaaatctttccttaggtaacgtccaagcgttcctccaatacacccaacagttctcacaaccgattactcaaattgtaaatattgctaatacacttcaaatgaccatggcttccgcagaacgagtttttgaagtgctagatgaaccagagatggaagatcttcacacagatgtagcggatgttaagacagatgctaagatgatttttgacgatgtggacttccgttatgttcctgataaaccattgattcgaaactttaatttgcgggttgagcccggagaaatggttgctatcgttggtccaactggagctggtaaaacgacgattattaatttaattgaacgtttctacgatgttaattcagggacggtttaccttgacgggaaggatactcgtaatatggaacggacggaattacgttctaaaattgcgatggttcttcaggatacttggctttttaccggaaccattcgagaaaacatcaagtatggtcgtgaaggtgcaacggatgaagaattatataacgcggctaaggcagcccatgctgattcatttattcggcagttaccagatgggtatgacaccattttaaacgaagcagcttctaatatttcacaaggtcaacgtcaattgctaacaattgcacgagctttcttagctgatcctgaaattttaattttagatgaagctacgagttcggttgatacgcgtacagaagtgttgattcaaaaagctatgaataatttattgagcaaccgtacaagtttcgtggttgcgcatcgactttctactatccgtaatgctcaaaatattgtggtagttaataacggtcaaatcgttgaaactggaaatcacgataatttaatgagccaaaatggtttctacgccgacttgtataattcacaatttgcaagtggtgaagtaatttaatttttaatgggttattcttcgtttgaaacaaaacggagaataacccattttttgttatataatgctattggaatttaggaaacggacggtaggaataaaaatggtatttactgatacagaaaatttaattcaagcgatgttggagcaacagataattcctggagcagactatacttttattcatcatggaaggttagttcatgaggtaaccacaggctatagcagcgtagtaccgattaaacggcgcttagcgcaaggtgagtattttgatgtagcttctttaaccaaagttatggggacggttcctttgacgctctggttagaacaacagggaaggattaatttagaagccccagtgagccaataccttccccaaattaaagatgcaagagttacgttacgtcatttgttgacgcatacttcgggagctacggcttggattgatcagcgggatgaattaaatgcgagtgaattacgggaagctatctacaataatttaactttcggagctgattttaatcaaaaagttgtttataacgattataatttcctattgctgggctttataattgaacgggtattacatatgccggttcaagtagcaattcagaaatatgtgctgcagccttggggattagaagccagtagcttcacccctgatcctcatcaagctattccaacgcaagtccgcaatggcatcttaactaagggacaggtacatgatcccaaggccgcttcgttaggcttgcatgctggttcagcaggactattttctaccaaacatgatgtggttaaatttaccctgaaaatgttagcaaatgaaaatgaacttttggatgaaacaaccatgcgccaattcgaagataatcaaacgactaattctaaattactccgttcatggggctgggcgtttgttactagaaaaccacatcaagttctactcagacatagcggtttcactggaacatttattttattggatcgtttaacacaaaatggattggtattcttatctaatcgggttcacccgcaacctaatttggaatttttagaatatcgacaaaaaatttatcaaacttttgccaaagaagatttttaaaaatgtaacttaaagaacaattgatgatgtggtattcttaggtaatgagtagatgaaaggggttttatagagcatgagtgaaccattatttttaaatccagtattccatgaaaaaatttggggaggggaccatttaagaactgaatttggttatgatattccaagtgaccacacgggagaatgttgggcaatttcagctcatccacatggtccagccaccattgctaacggaaaatttaaaggtattacgttagacaaactatgggaaagtcaccgagaacaatttggaaatgccaagggggaagtctttccactcttaactaagatcttagatgctaatgacgatttatctgttcaagttcatccagatgatgcctatgcagctgagcatgaacatgaattgggtaaaactgaatgttggtatatcatctcggccaaaccaggagctgaattatactacggtcataacgctaaaacacatgaagaattggcagattggattaataatggtcaatgggacaaattattccgcaaagtgccagttaaagccggtgaattttattatgtgcctagtggtacaattcatgctttaggtaagggaattatggttcttgaaactcaacaaagcagtgatacaacataccgcttgtatgattttgatcgggtagataaaaccactggtgaaaaacgtgaacttcatcttcaacaatcaattgatgtaactaacgtacctcatgaagatcctaaacttaacattactactgacgaagtaggcgacgctgaggtaactacatttgttaaagctccaatttcaaagtatttctcagtgagaaaagtttctttgaaagatggcgaagttagctttgagcgtgaaggtttgtacaccttagtttcagtattagatggagaagggaacattactgttgatggaaaaacatatactcttgttaaaggtcaacactttgttcttcctaacccagtcaaagaatggagctatagtggaaaacttgaattaattgttagtgaacctggtgaagcataaaaaagagtatctaagaaaaaattttttcttagatactcttttttagtcttagaaagttggttcaatagtaagttctttttgaggagttaaatcagcatcaggatatttacgactaagagcagttaaaattatacgcttagctaattcaccattacgagttaggattggaccatggaaataagagccataaacgtttttataaatgactccttctgattgatcttcaccgttgttaccatggccagactgaacttcccctaaaggacgttctcccttaccaaggaaagttttcccgttgtgattttcaaaaccatggtaaatttctccagtttcagcatttttgataacaatatcgccaatgaagcgattatcgtcttgacttaatgtgtagtgatctaaagcatcaatccctttaattttctcaccattcgcaccaacgtagtaatgacctagaagttgataaccaccgcagatggcaagtagtggaccgccatcttcaatataatcagttagatcttcttttttgtgttgaatatccttggaaacgatggtttgttcatagtcttgaccaccgccgaaaaagacgatatcccagtctttaggattaaattgatcatcgagactaacaatgtcaatatctaaatctgtatccatttttttagcataatattttaaagctagtaaattaccgttgtcaccataggtattcaataggtcaccataaagatgagccacgtttagattgtatttcatattaaatcccctctttgatgtaaccttctgtagctaattgtttacgtaattgaagcatggcagtgtaagttgcaaatacgtaaacacgcttggtaggtaaatttttaatatttgaaacagcatcttttaaattatcataggtccaaagttgattgtcctcaactccagctaccttaagacggaaagtgatgtctttgtaacgttcgccacccgtcatatattgttgaattggcatttgcgttaatttttcaaaatttccatcccaaatccaacttgtatcaatcccatcagcatagttagcatttagtaaaccaacaaaagaaaaaggttcgctttcagttccaaccatatcaattacttggtttaaaccaacaggatttttaactagcacgatggtaatttctttaccatctacattgatttgttcttgtcgtccaaaaacccgctcatcggggtcatttaaagccttttgaatgctagaagtaggtactcccataaatttaccgaccgaataggcggccagtgcattatagacattgtaaagtcccccgatgtgaagggtaaagttggaagcatcaatgaaaaatttagataaattgggagtaagcttggtaatctgggtaagttgataagtcaattcgggacgttcccagccgcaattagggcaataatacttaccttgattgctataactaataaatttatagtgaataatatgttcgcagcgaggacaaaccacgccatcagtattcggatctgccttcatctcaccgtcgggttgattgttaaaaccatagtagacaacaggattaggaaggtcaaccgaattgaaaatcggcatgtcgccattagcgataatggtagcttccggagctaatttaaccccatctaatatttttcgataggttgtgtaaatttcgccatagcgatccatttgatctctaaatatattagtaaaaacgaaggctaagggtttgatatattgtgttaccttaatgacgttagcttcgtctacttctaaaatagcaatatttttgccttttttagatttatggtcagttaagaaagtggtgacaatcccttgttccatgttcgaaccagttggattagtaagaacatgatcaaacttttgacgaagaactttaacggttaaagcagtggtaagggtcttaccattggtaccagtgattacgatcacatcgtagtccttaccaagatcttttagaatggttggatcaatcttagtagttattttgcctggtagtgaacttcctccagaacgaaatgtgtgtaaaaaccaatatgacgatttaccggccattttggcaattgaacttttaaatgacatgttaagccctccgaatatctttaaaacatctaaaatagtattttaagctgaaattgataaaaaagaaagtttcttatattaataagagatgaatttttattttatatcagctatacttaaatttcggagaataaaattaggagtggggctagaatggcacagttattttttcattacggagcaatgaatagtggtaagtcaattgaaattttaaaagtggctcataactatgaagaacaagataaaaaagttattttaatgacgagtggtattgatactagaacggctgttggtgaaatttccagccggattgggttgcgccgagatgctcttccaatttttgatgatacgaatattttggaattgattacgcaagctagtgcccaagaagatactgcttgtatcttgattgatgaagctcaatttttgaaaaaacatcacattatagaactagctaaagtagtcgatgacttaggaattccagtcatgacgtttggtttaaaaaatgatttcagaaatgaattgtttgaaggaactaaatacttacttttatatgccgataaaattgtggaaatgaagacaatttgttggttctgtaagcacaaagcgctaatgaatttacgcgttcatgatggtaaaccggtctatgatggtgagcaagttcaaattggtggtaatgagtcttattacccggtttgtcgtcgccattattttcacccactgactgaagaagaaatgaggaattaattaaatggatattattgaaaaagttcaggctgttgccgaccgctatgaagaattaagcgaactattagctgatcctgaagttttaggagattcacaacgttatcaagagctttctaaagaagaaggcgaaatccgtgaaactgtggaaaagtatcgtgaataccgaaaaacagttgatgctattgctgaaaacgaagaattacaacgtgaaaaattagatccagaaatggatagtttagttaaagccgaattagctgaacttcgtgaaactaaagctactttagaagaagaaattaaaattttaatgttaccaactgaccccaacgatgataaaaatatcatcatggaaattcatggagcagctggtggggatgaagctagtttatttgctgctgacctatacaacatgtatactcgttatgctgaaacccaaggatggaaagtagaagttgtggatgagaatgctactgacgttggtggtttcaaggaaatcgtattaatgatttctggtaacaaagtttattctaaattgaagtatgaaaatggcgcacatcgagttcaacgagttccagttactgaatcggcaggacgagtacatacatctacatcaaccgtaggagtaatgcctgaagcggaagatgttgatattgaaatcgatcaaaaagatattcgtacggatgtttatcgctcatctggtgctggtggacagcatattaataagacttcttcagcggttcgaatgacccacttaccaactggtatcgtagttgcgatgcaagatgaacgttcgcaacaacaaaatcgtgaaaaggcaatgcgcattttaaaggctcgggtctatgactattaccaaacgcaagaagaagatgcatataatgcagaacgtaaaagcgctgttggtaccggagatcgttccgaacgtataagaacttacaacttccctcaaaatcgggttaccgatcatcgaattggtcttactttgaacaagttagatcgagttatgaatggtgaattagatgatatcatcgatgctcttattctcgatgatcaagccaagaaagtggaacaacttcgtaatgaataatattccaacttattttgaagccctgagatgggcttctttgtttatccgaaaaaaccaaggagacgagaatgctccagaattgatcttgatggatacaatggagtggtcaagaaccgaattaatcatgcattaccgtgaaaaactttttcccgaacaatgggagaaatttcaaaccgctgtgaaaagagttgccaagggagagcctgtgcaatacgtaacgaataaggctactttttttggacgtgaattttacgttgacaaacgggtgttaattccacgggttgaaacggaagagttagtcgaaacgattctaagtaaaactaagcgcagtcgacagagacttcgagttttagatattgggacggggagtggtgatatagcgattacgcttaaattggagcgtccagaatggttagtcacggcggttgatatctctaaagatgctttaacagtggctcaacggaatgctgaaagtcatgaagctatcgttgatttcaggctagggtcattgtttgaacccgtccaaggggaacgttttgatttaattatcagcaatccgccctatattgcggataatgaaaagcatgaaatggatcaatcagtgattgactttgagcctcatcaagccttatttgctgacgaccacggattattttggtataaaagaattgcagatcaattggatcaatatttagtcgaacacggagaattgggttgcgaaattggttatcgtcaaggtacggacctaaaaaagtatttcttagaaaagaagtatattgaccaagcggaagttataaaagatcttagtcaacacgatcgaattctttgggttaaaaagaaataggtgataaaaatgagtaaattatttagttctgatgaaatacaagtagcggctcaagccatcaaagctggtgaattagtatctttcccaaccgaaaccgtttatggactgggtgcggatgcaactaatccagaggcagtaaaaaaagtttatgctgctaaaggacgtccttcggataacccactaattgtccatgttgcggaccaaacagaagttgcaaattttgctaatattgacgacaaaagcaaaaaattaatggatcaattttggccaggaccactaaccattatcttaccaattaaaaagggagctttaaattcgattgttacaggtggattagatacagctgcttttcgtaatccggctactcaagtaacaattgatttaattcgtgcagctggggtcccattggtgggcccatccgctaatacatcagggaaacctagccccactaaaccggagcatgtgttgcatgatttggacggaaaaattgctggagttctagatgatggggaaactaccatcggtgttgaatcaacggttttagatatgtcaggtacaacgccaagtatcttgcggccaggggccattacagaacaagcattggcacccttaataggtgaggttcaaaccgaccatcataaagtcggaaaagatgaagttcctaaggcgcctggaatgaaatacaaacactatgctccgaatgcccaagtatacatagtgtctgatcaggattgggacggtgtcgtagcttggctccaaaagcatactgatcaaactattggaattatggccacaaatgaaatttttgagaccaaaaaattaggagaattcgaccaagttcgatacatttccttaggggtagattctaagacggctagtcgagaactattcgatggattacgaacctttgatgctgattcagcaataaaaaccatttttgctcaaggatttgatagaatagggattggcgaggcatacatgaatcgtctccaaaaatctgcaggtaacacatactttagtgacatcgattagggggaattggtcaatgaattatacaaaacaagatccagaattatggtcagcaattgaacgtgaagaaaagcgtcagcaacataatattgaattaattgcttcggaaaatattgtatctgatagcgtacgcaaggcccaaggtagtgtacttactaataagtatgccgaaggttatcctggcaaacgttactatggtgggtgtgaatttattgaccaagtcgaacaattagcaattgatcgagcaaaagccatctttaatgcggaatatgtaaatgttcaaccccattctggttcccaagcgaatgctgctgcttatgccgcgtttattaaacctggggataaaattttaggaatggaccttaatgctggtggacatctaacacacggtgctaaagtaagctttagtggaactttttatcaatcagtgagttatggggttgatcctcaaactgaaaaattagattacgatgaaattcgtcgtattgctttaaaagaacagccacaaattattgttgcgggagcttcggcctatagtcgatttattgattggaataaattccgcgaaattgctgatgaagtcggggcttatctgatggtagatatggcccatattgctggtctggtagcagctggtctgcatccttcaccagttggcattgctgatgtggttacaactacgacacataagaccctccgaggtccccgtggtggcatgattctttcgcaggaaaaatatgccaagcaacttaattttgcggtatttcctcaaaatcaaggtggtccattagaacatgttattgctgcgaaggccgttgcctttggtgaagcattgcaaccagaatttaagacttatcaagaacaagttttaaaaaatgcgaaagcaatggctgaagtctttgaaaatgatacgattttgcacgtagtaacgggggggaccgataatcatctgatgacagtagatttaactgggacccaattaaatggtaaggaagtacagaatctgttaggtggcgtcttcattactactaataaagaagccattccagaagaaaaattaagcccatttaaaacctcaggaattcgaattggaacgccagctattacgacacgaggatttaaagaagacgactgtcgtgaagttgctaatttgataattcgagcaatcaaaaatgcggataatgaaacagttttagaagaaattaagcgagatgtgttcaaactaactgaaaagtaccctattgattaaattagtcctagtttttttatgtttttttagctacaattgataaggaatttgaaaggagcgagtttagtcatgggtaagtttgaggttctcgatcatccgttaattcaacataagttaactttgattagagataaacactgtagtacaaaagaatttagagaaatcgtcaatgaaatctcaacattaatggcatatgaagtatcacgagatatgccactgatggatgttgaaattgaaacaccaattggtaaatcaattcaaaaacagatttcaggtaaaaaagtggcgattgttccaattctacgtgctggtttaggtatggttgatggaatggccgagttattaccagttgctcgtattggtcacatcggaatgtatcgtgacgaagaaacattaaagccaactgaatactttgtaaaattaccaagtgatatcagtgaacgtcaagtattcgttgttgatccaatgcttgctactggtggatcagccattatggctgtggatgcattgaaaaaacgtggtgctaaagacatccgtttctgtagcttagtagctgctcctgaaggggttaaagcattacaagaagctcatccagacatcgatatttacacagctgctctagatgaaaagcttaatgaagatggttacatcgtcccaggattaggggatgctggtgatcgcttattcggtacaaaataaatctttaaaaagaaggccattggccttctttttttgtatgttattagtattaaaacgaactaagctttatatattagtaatatagtaaaaattcgggggaatcagcatggcttatatcgaagtaaaaaacgagtcaaaagtgtaccaaatgggtgaaacaaaaatttttgctaatcgagatgttaattttgaagttgaagaaggtaaagtgacggtgattttagggcctagtggcgcaggaaaatcaaccgtattaaatatgttaggtggtatggatagccccactagtggtcaaattatgattgataatatggatattgcgacatttaacgatcgccaattaactaattatcgacgccatgatgtaggattcgtatttcagttttataatttaattccaaatctatccacattggaaaatgttgaattagctacttccttagttaaggatggacaagcgcccgaggaagttttaaaagcagttggattacaagaaagaatggataattttccttcccagctttctggtggtgaacagcagcgtctagctattgctcgtgcgttggctaagaatcctaagttacttttatgtgatgaaccgacgggagctttggattatcaaacaggaaaacaagttttgcaattattaagtgatgctagtcgtaaatttcataaaacggtaatcattattactcacaactctgaaattgctcaaatggctgatcgggtaattcagattaacgacgcccgagtgcgagcggtaaaagataatgctaatccagttccagttaaagacattgtttggtagggtgagctaatgaataaactattaatgcgagatattaggggatcgttaggacgatttaccgcaatcgtcctaattattatgttaggtgtactattattcgttggagtgaaagcaactgggcctgctttgaaccattccatgcaatcagaggtcgttaaacatcatttgagcgatgtgcaggtcttttcggataagggatttacccgaaaggatatcaaagctgtaaagcgcgttcaaggagctaaagcggagagtattaaatttaaatatgtgattggtggaaaaacaggtgatgcgattgcactatacggtttgaaagatccagctagacaaaatcaagttattttaaaaagtggacgtctgccccaaaaaaataatgaaattttattagataaacaagcgcaaattaaggatgggtatcgaattggtgaccagtttacttttgcaaaatcagctaatcttaaagtcaatagatataaaattgtgggttttgctgattcacccctgtacatcgacgattctactagaggatcagccaatgttggtagtggtcaagttcagtatttcgcttatattaaagaccaagcaatcaatttgcctgtcgcaacagcgataaatattagttttgctaagcttcaacatcaagatgttttctcaggaaagtatcaaggaactatcaaagctaaagtaaaacttttgcagaaacaattggataaacgaaaaaacgagcgaaagaatgaaattgttgcaaaacctttaaatcagattaatagagctcaggaaaaattaaatcaagctaagcaaaaaatagttcaagctaaagcacaattaaaaaagcaatctggaggaaaggtaaccactacttcagagcttgataaacaagagcaacaattagcggaaacgcaagttaatttgaaacggcagcgaaaaaaggttgaaaagataaaagttccaagttacacatggcaaactcgtgaagatttacctggattcactggctatggagatagttctgaccggatcgccgcaattgcgaatgtctttccagtgttcttttttctgttagctgcgttaattaccttcactaccattactcggatggtagaagaggcccgtgggcaaattggaacattgaaagctttaggattttctaggagtgcgattgcctacgaatacactatgtatgcttttttggctggaattttaggagcaagcgtgggttcatttttaggtaaccaattattgccacgttttgtcgtatcaatgtatacaaagtatgtaattggtcaaccggtcattgaatatgattgggcttcaattgcaattgcagtggttttggcaatgattgccacagttggagcggccttattggtagtaatcaaggaaacaaaagcagttccagccgagttgctacggcctaaatctccgaagaaagctaagaaaattttgctagaaaatattagttttatttggaaacgtctaaattttaatcagaaaattagttatcgtaacctatttagatttaagctgagaggcttaatgacgattttggggattgcgggtggaacagcccttgttttgacaggatttggcattgccaattccatttcagcaactggagatcttcaatttaatcaaattattaaatatgatgctgtagttcaagctaaaaaagccaaccaattagaatcggttcggcagacaattgctaggggaaagaattatcagcaaagccttgcgacccatacggaaacttttaaagcaactaagcacggtaaaaccgtggatgatatcaatatggatattcctcaaaataagcaccaatttgaaaaatttgtaactttaagggactatcaaaaccaacatccgttgcatttgcaaaagcagggggtaattatttcagaaaaacttgccactgccttaaaagttagaaaaggaagtacaatttctatagaaaatgaaaagcaaactaaaaaagaagttaaggtgatcggtgtaacccaaaattatgttggaaactttatgtatggatctacttctttttataggaaaactatgaaaaaagaacctacgatgcaaactttaatggttcaattacatcaaacttctaaaaagaatcaacaaaaattaagcaagcaatggattgaagctaatgccgatattttaggtgtgagttttgtgagggatcaagctttagcagttacaagcatgtctaagcaattaggaccggttgttttgatttttattctcctatctggagtgttatctttcattgttttatataacttgaacaatattaatatttcagaacgtttgcgagaattgtcaacaattaaagtactcgggttctttgattcagaagttacaatgtatattgctagggaaagtattattttagctttgattggaatactagctggttttggattaggaaatattttgacaagttatgttatcaaacaagctgagactagcatcgtcgtctttccactaacaattaaaccaatgggatacgtggtagcagctgtattaatggtcatttttaatttaatagttgtttatattacgcatcgtcgactaaggcaagttgatatggttgaagcattgaaatcaaacgaatagttaagaatttcagagataaataaattttatttctgaaattctttttgattttaagtagataaattgaacaaatttcaatttttgaagaacgaacaggaagaatatcatagaaataaagcgattattcttttgtcttttgtccaaaatggtggtatcatttcaaatgtattttcagacggaaaatactgtcttttgttcaagtttatgacttagattattgtcaatttttggctttggtttaggtacacttaggtagaaaagaggtgatattctgtgagtggtgaatcaatttcaacttttcagtttcttggtttgacatttaatacgactaacttaatttcaggtttagtaagtgcactaattgttttttgtgtagtgtttgctttatctcgtaatttgaagttaaagccgactggtaagcaaaatattttggagtggatcgttgattttaccaatggtatcctccgcgattcagtggatgaagaggaagaaaagaattttggtctatatgctttcacattattcctatttatttttgtttctaaccaaatcggtctattcctgcaaatcgcatggaatgatgtttcgtatctaagaagcccaacagctgatccgattgtcactttaacattgtcgttgatcacaatgatgttagcgcactattcaggtgttgcaaaatttggctttaaaaaatattttgaaaaaacatatttatcgccatttaaagtttggttaccgattggtgtttttacagaattcattgatttcttgacccttgggctacgtatctacggtgttatttttgccggcgaaatgcttcttaagatgatcggaggaattgcattctcgggtggcatcgtcaatatgattgtcgccatcccacttgccttgatttggcaaggattttccgtatttttgggaagtattcaggcgttcgtgtttgtaacactaacatccgtttacatttctcataaggtcgaagacgaataataatatatttttaggtaggaggaacaactattatgggtgctattgcagctggaattgctatgtttggagccgctattggtggtggtatcggtgacggtatcgttgtcgcaaaaatgcttgaaggaatggctcgtcaacctgaattatcaggacaattaagaacaacaatgtttatcggtgttggtttggttgaagctatgcctatccttgccttcgttatttcacttcttgtaatgaataagtaggcatgataaattaaacaatttatcggagaaggaggtgtcaatagatgttttcgcacattatagtaggggcggcacatggaagtactttgtacgttggtgatatgttgttttatgccatcttgtttattgtattaatggctttaattgcaaaatttgcgtggggtccagttaatgcaatgttgaaggaacgtgctgatcgtatctctaacgacattgactcagctgaacagtctcgaatcgaggctgaaaagcttgctaaacaacgtaaagaagcattagataattctcatgctgaagctacttctatcattaacaacgctaaagatagtggtgcaaaagaacgagaattgattattggaaatgctcaaaatgaagctaagtctctaaaggacaaggctaaacaagatattgaacaagaacgtgctgacgcacttaaaagtgcacaagacgatattgcgtcattatctattgagattgcttccaaagttatcaaaaaagaacttgatgaaaacagtcaaaaggatttgattgattcatacatcgaaggtttgggtgatagcaaatgagtttagataaaacaacaattgctaagcgttattcaaaagccctctttgaaattgtttctgaaaaaggacaacgcgatgaaacacgtgctgaactaaatcaaattcaacaagtttttaatgataatgaaggattaggcaaaattttaactgacaaaggtttggagcaaaatcaaaagcttgaaattctcaatattttgactaaagatgcttcaaattacgttggaaatctcatcaaaatgacttttgattatggtcgtatggactatttgacagcgattattgatgagtttaacaacttgtgtgacgctgatgaaaaaatcgttcgagcaaaagttgtttctgctatcccattaagtgatcaacaacttgataaaatggcagaacaattcgctaaacgtttaaaagttagtgaagttgtcttagatagtgaagttgatgattcaatcatcggtggagctatcatcaaaacagatagtttgatctacgatggtagtattcagactcaaattaatcaaattagacagcgcctaataggttagctcgatatttgtaaagaggtgaaacttttatgagcattaaggctgaggaaatcagtgctctaatcaaacagcaattagaaaactaccaagctgagcttaatgtcgaagaaactggtaccgttacatatgttggtgatggtattgctcgtgctcatggcttaaataatgctctttctggtgaacttctagaattctctaacggtgttttcggtatggttcaaaaccttgaatcaaacgatgttggtattgttatcatgggtaactatgatggtatccacgaaggagacgtagttaagagaactggtcgtatcatggaagttccagttggagatgccttaattggtcgagttgttaacccattgggtgaaccacttgatggcaagggagcaatccaaaccaccaaaacccgtccggtagaaaataaggcacctggtgttatgcaacgtaaatcagttgaacagccacttcaaacaggtattaaagctatcgatgctttagttccaattggtcgtggacaacgtgaattgattatcggtgaccgtaagacaggtaagactacaatcgctatcgatacaatcttgaatcaaaaagatcaagatatgatttgtatctatgttgcaatcggacaaaaggaatcaactgttcgtacacaagtagaaacattgagacgttacggtgcgatggactatacaatcgttgttagtgctggtccttctgaaccagctccaatgctatatcttgctccttatgccggagcagcaatgggtgaagaattcatgtacaacggcaaacatgttttgatcgtatacgatgatctatcaaaacaagctgatgcttaccgtgaactctcattaattcttcgccgtccgcctgggcgtgaagcttaccctggtgatatcttctatactcactcacgtttgcttgaacgtgcagctaagttgagtgatgatttgggtggaggttcaatgactgctttgcctttcgttgaaactaaagctggggatgtttcagcttatatcccaactaacgttatttcaatcactgatggacaagtgttccttgatggtgattactttaactcaggaactcgtccagctattgatgctggtacttctgtttctcgtgttggtggggatgcccagattaaggcgatgaagaaggttgccggaactcttcgtttggatttagcttcatatcgtgaattggaatcatttgctcaatttggttcagatttggataaagcaactcaagctaagttggctcgtggtcgtcggactgttgaagttctaaaacaaccacttcatcaaccactttccgttgaaaaccaagttatgattctttatgcattaactcatggtttcttggacaatgttcctgtcgatgatattcaacgtttccaagatgaactctttgactatattgcaagtaacaataaggagctcacagacgaaatccgtgaaactaagcaacttcctgatacggacaagatggatgcagcaattaaatcatttgctgaacattttcaacctacaaaggaagctaaataaggatatcagctaacgagaggaaaagtggtgagaattaatggcaatatctgaacaagatgtaaagcgtcgaattgattcgactaagaaaactagtcaaattacgactgctatgcaaatggtttcaactgctaagttaagccaaattcagagacatacagttggatatcaagtgtatgcacaaaaagttgagagtattgttgctcaccttgctaaatcacatttaatgagcgctagtgtagctggtaaggctaagtctgaccaagctatctcggctgctgatttactagcacaacgtcctgtcaagaagactggatatttaattatcacttctgatcgtggcttagttggttcatacaacagcagtgtgattaagcaaacaaacgattttatgcaaaagcatgggcatactgaaggcgatgccgttattctcgcggtaggtggcactggttctgatttctatcgaaatcgtaatcatgaagttgcttacgaataccgcggtgtcagcgacgttccaactttcaatgaaattcgtgaaattgttaaaactgttactaaaatgtacacagaagaaaaatttgatgaattatacgtatgctacaaccactttgtaaatagactttcaaatagtttccgagtaactaaattacttccaattggtggagatgatttggctaataacgaagctcatgaacaagttactgctgagtatgacactgaaccatcaccagaagcattattgcaggaaattcttcctcaatatgctgaaagtttggtttatggtgctatcttagatgcaaagactgcagaacatgctgctagttcatcagcgatgcgctcagcatctgataatgctagtgatttgattgcagatttagagctacagtataatcgtgctagacaaagtgctattacgactgaaatcaccgaaattactggtggtcaagctgcacttgaataatattaacgagaggaattaaacgatatgagtactggtaaagttgttcaagttatcggaccagttatcgacgttgaatttccccttgacgaagaattaccaactatcaataacgctttgaagattaaaaaggcggatggtactgtcctagtttctgaagtaacgcttgaattaggtgatggtgttgtaagaaccatcgctatggatggaacagatgggctacaacgtggtcttgatgttgaagatactggagattctattaaagtacccgttggtaaagaaacacttggtcgtgttttcaacgtcttgggtgacactatcgatggcggcaaagaacttggccccgatataaaacgcgatccaatccatcgtgatccaccagattatgatgaattgaatccaagtacagaaattcttgaaacaggtatcaaggttattgacttacttgccccatatattcgtggtggtaagattggtcttttcggaggtgccggggttggtaaaaccgttttgattcaagaattaatccataatattgcacaagaacataatggtatctcagtttttactggtgttggtgaaagaacacgtgaaggtaatgacttatacttcgaaatgaagggatccggagttcttgaacgtacggccatggtatatggtcaaatgaacgagccgcctggggctcgtatgcgagttgctcttactggtttgacaattgcggaacatttccgtgatgttgaagggcaagatgtgttgttatttattgataacattttccgtttcacgcaagctggttcagaagtttcggccttacttggtcgtattccttcagccgttggttaccaaccaacacttgctacagaaatgggacaacttcaagaacgtattacatcaacaaagaagggttcagtaacatcaatccaagcagtttatgttcctgctgatgattatactgatcctgctcctgctacaacatttgctcatttggatgcaactactaacttggaacgtgcattgactcaacaaggtatttaccctgctgtggatcctcttgcatctacttcaactgcgcttgacccacaaattgttggtgaagaacattatgaagtagctacagaggtacaacatgttctccaacgttataaggaattgcaagatatcatctctatccttggtatggatgaattatctgatgaagaaaagaccgtcgttgctcgtgcacgtcgtacccaactcttcttatctcaagacttcagtgttgctgctcaatttactggccttccaggtcactatgtaaagattgaagacacaatttctggattcaagggtatccttgatggtaagtatgatgatcttcctgaagaagcattccgtttggttggatcaattgatgatgtagtcgaaaaggctaaaaaaataagtgctacagaagattaggagggatctaattggctgaaaattcagtattaacagttagtattgttactcctgatagtcaagtctatgatgatgaccaagttaccatgttggtagttaataccaaagaaggtgaattaggtatcttgcctaatcacgttcctgtaattgctgctcttgcgattgatgaagtgcgggtaaaacacagtcaagaggaagacgttattgcagtaaatggtggatttgttgaattttctgagaatactgcaactattgttgcggataccgctgaaaatcaatctgatatcgacgtagctcgtgctgaaagtgctaagaaacgtgctgaagcaacgattcgtaaagcgcaacaagcacacgacaatagtgaattacggcgtgctcaaatttcacttcgtcgggctattaaccgaattaatgtatcaaaacattaatttagttattggtcataaaaaacgctcaattttgagcgttttttttgtgtttaaaaatgataaatttagcttagtttctggtacaataatacatgtatgaaattttggaggaaaattatgttaggaattcaatctgtaataactttaatttgttatctatttttcatcctgatttccttttggagtattcaggctattccatttcataaatttatgggaagatatgagaatcaagcacgggttttaatcgtattgctgtctgtggttattggatatacggtaagtagttttttcttaaatttaattacaacgattgaaaatttaacatttttagtcaaataggggattaaacctaaatgaagcaaattttgttactgattattcgtgggtatcaaaaatttatctcgccaatgtttccgccatcttgtcgatattatccaacttgttctaattatagcctccaagccatcaaacgatttggtgccataaaaggcggcttgatgggggttgcaagaattttaaggtgtcatccatttgtgcgaggcggatacgatccagtgccagataatttttctttaaaacgcaatcaaaaaaatagtaaaccaagaaattaggagttaaaatgtctagaagagagaaaaagttcgaaatcgaaattaaagaagttaaagaaaatgattcagttatcaatgaggtttatatcaacagacagttagttggtcaaatttctcaagtaaatgataagaattttacagcttctaaccaaagtggagaaatgcgtgtaaaatctatggatgaaggaattcaatggattgtagctgaatttaacctacattctctatagaaaggagctacctcgatggaaagaatgaattctagggttgctcgaaaggatgatagttcccggattgactatggaattatttttccagtgctaatgctagcaattatcgggctggcgtccatctacgtagctgcgacacatgatactagtgctacaagcatcttacgacaggttgtttctcagttagtttggtacgtattgggtatcgtaattgtcactgtcataatgcaatttgattcgaaacaattgtggaaactagcaccaattgtgtatggaattggactacttttgttagttctagtcttatttctatacagtcgagcctacgcggctaatacgggagcaaagagctggtttgctctaggaccctttaccttccagccctctgaagtaatgaaaccagcttatattttgatgatggcaaaagttattacggtttacaactcaaaagtaaaagagcgcacagtccgcagtgattggaagcttattggaacaatgattttatggactttaccagtgcctattttgttattgttgcaacatgactttggtacgatgttagtgtttattgctatttttgctggattagtcgtggtttcgggagttacttggcgaattttggtaccgtcttttgtcggaatggtggtattaggaagttcaaccttgatgctggtcgctacaagttggggacaatcatttttgagcaagttaggttttgaatcttatcaatttgctcgaatcgataattggttgcatcctgcttcggatactactaattcaggttatcaattatggcaaagtatgaaagctatcggttctgggcaattatttggaaaaggtttcaacgtttcgaacgttaacgttccggttcgagaatctgatatgattttttcggttattggagaaaattttggatttgtcggtagtgtagtattaattggactatactttttattaatttataaaattatccaagtcatttttgatactaaaaatgaattttatgcgtatatagcagtgggagttatcatgatgattctattccatgtatttgaaaatattggaatgaacatcgggcttttaccactaactggaattccgctaccgtttgttagtgcaggaggttcggcattgatcggaaatatgattggcgtggggttaatcatgtcgatgaggtaccattattattcttatagtaaaacaggattagaacaaaaagctgatttctaaaaactagtgatacaaattaggtatcctagtttttttatttttagtgttgacagctaaactgatggcatgtatactttagcctattaacaaagtattagagaaagatgagtaaacagatttatctacgcttagagagtttccggttggtggaaggaaatcgaggtaatcgttgaagatggtctttcaatttattcagcggatttgtgagcatttagttagcaaatcatgggagcgcccattacagcgcacgggttgattgacccgcagagttcgttgaccgtaaggcaacgaaaaaacaaggtggtaacacgacaaactttcgtccttgaatatagctttagctatattcgggcgaaagtttttttgtttaaaagggggattagaattgattgaatttaaggacgtttcaaaaacttttgaaaccaaagaaggaacagtccacgcaattaaggatgttaatttaaaaattgatagtggaaaaatatacggcattatcggatattctggtgctggtaaaacgactttaattcgaatgttaaatggtcttgagaagccgacaactgggagtgttaatatcaatggagtagcaatcaatcaattatcagctaaagatttacgcgtccaacgccataaaattggaatgatattccaacattttaatttattatggtcaagaaccgtaaaagaaaatgttatgtttccattagaaattgctggagttgctaaagctgaacgtgaaaagaaggctttagagttaatcgatttggttggtttagaaggaaaggaagatatgtatccagcttccctatccggagggcaaaagcaacgagtgggtgttgctcgagcactggcaaatgatccagaaattcttctctctgatgaagctactagtgctttagatccagaaacaaccgatgaggtactagatttattacttgatattaagaaacgtctgaatatcaccattgtattgattacccacgaaatgcatgtcattcgtaaaatttgtgataatgtagccgttttagacggcggtaagattattgaagagggagaagtactgaatgtcttcaaaaatcctcaacaaccgttaacacaacgttttgtttccgcagaatctgatccaagtcatcaagaaacagaaattgttttagatgagttattaaataaatatcccaatagtagaatcgttcggctaactttccatggggatcaggctaaattaccgatcgtttcggaaatggtacatgaatttcccaaagttgatttaaatatcgttgcaggtaatattaagcaaactcaagagggttctattgggacattatatttacaattaacaggacctgaaccacaagtagctgggtcggttaatttcttaaagaaattacgggtagaaacggaggttatcgcagatgggaagtagttcttattttgattttagttcagttgattggactgaaatggggagtgcaacttgggagacgatttgggtaacgcttgtgtctgttttattcacagcaattattggctgcttgataggtctcttactctttgaaaccaaagatagcaagagtaaaggaattcaggtagttaattggttagtttcgttatttgttaatgtattccgatcaattccttatattattttaatcgttgttttgattccttttactaatacgttagtccacaccattgtaggtccagtagcagctttaccttctctaattctttctgcggctcctttttttggacgaattgtagaaatgtcgtttagagaaattgatcaaggcgttctagaagcagcagaagcgatgggtgcaagccattggacaattatctttaaagttttgttacctgaaagtttacccgcgctggtatcaggcttgactgttacagcaatttcgttagtaggatatacagcaatggctggagccatcggtgcgggaggcttaggcgccttagcgtataacaatggtttcttgcaatataatggaacaatcattctggtggcaacgattctaattgtattatttgtttttgttcttcaatggattggtgatttattagttaaaattattgataaaagggttgtttaatcaaggaggaaatttttatgaaaaagagtagagttttaaccgcattaacaattgcagcaactgcagtagctttggcagcttgtggaagtaccgctaaaaaaacaacgacggttaccattggggcttcacctacccctcatgcagaaatcttaaagcatattcaacctgaactaaaaaaggaaggggtaaatcttaaaattaaacaatttcaagattatgttttacctaacaaggcattagcttctaaagatatcgatgctaactacttccaacacactcctttcctaaaagaatggaacgccaagaacaaaggaaatttgattagcgcaggttcaattcacctagaaccgattgcagtttattcaaagaagtataaatcactaaaagatctacctaaaaatgcgacggtactagtaagcaataatgtagcagattatggacgggtgcttgaaatctttaaagatgctgggttaattactctcaagaagggtacggataccacgaatgctaactttaaggatattgccactaataagaagaatattaaatttaagacggggtacgaacctaaattgatgcctcaactctacaataataaacaaggtgatgcggaagtaattaattctaattatgcagttcaggctaaattaagtcccgccaaagatgcgattgcagttgaaaaatcatcgtctccatatagcaacattgtagcaattagaccagatgaaaagaacaataaagcccttaagaaagtgattaaggcacttaagtcaaaatcaactcaaagttggattaaaaaacactttaaaggttctgtagagccggttgaataacttctaaaatctgtaataacactgaatgttattacagattttttgttggtctgacggggttaaacatgtcaatttaattgactttttgcacgataacccatatagttagttacatgactaattaagtttataatgaaggaattaataaaatttgaaggtggatgttatgcaatttaattttaatagcagcgaaccaatctatctccaagtcgcccaacagattgaagatgcaatctttaccggcggttttaaagagggagaacagatcccttccactactgaaatatcaaaagaatttcacataaatcctgcaacagttttaaaaggaatgaatcaactggtttcacgaaagcttttagaaaaacatcgtggagtaggaatgttcgtggctgagggggcaagtaatcaaattactttgaatcgccagcaaaatttctataataagtatgtaataggggtagttaaggaagcagttcgccttaatattaatgaggaagatttaaaaaaattaattgaacaggggtataaatctatatgaaggggatcgaagtaaagcaggtaaccaagtcattcgataaaaaaatgattttaaatggaattgggatgacaattgagcctaataaaatttatggtttgttaggtcgaaatggggctggaaaaagtactttactaagcttattagtaaaccgaattgctccggatacgggaggaattcggttagataataaagttattcgtgataatgatgaacaactctctaagatgtttttgatgagtgaagtggatctttatcctaaaaaccttaaagttaaggatgttttcaagtggaccaagagcttttacgggggctttgatgaagaactcgcacaagatttatgtgagaagtttggattacaaactaatattatttttaataagttatcaaccggttaccgtactattatgaagttaatcgttgcattggcggttccggtggaatatgttttcttagatgaacctattctaggtttagatgccggtcatcgagaaattttctataatgccttagttgagacatatgcggaaaatcctcgtacttttgttatttcaacccatctaattgaagagattgctaatttaattgagcatgtcttagtaatcgatcatggtcgtttaattgtggatgatgaaaccgaaaaagtgctaggtgaagcttacgtagttagcggacctgaggacaaggtggatgaatacacccaagggttgaacgttattgggagcgataaattggctcgaatcaaagctagttatgtttttggttcattagataacaaaccaatttcggacttaattaacattgatcaaatggatttacaaaccttatttgtcaatttaacaaatggaggtaatgagaatgaataaagtagctagcgtaatcaagtacgatttaagttattttgtccgcttgattttaattgtttacctgtggctaattggtttgctagtaggaattccagtgctattacatttagtagccagtggtaccgaagggatggccattgccatcttaaatgatttatctctattaacgacggcagccttgtttgttaacgtagccttactattttattttggctttttaacgtacgagcgcttttctttcttaattcaaaatggaatttcgcgaagaacaggttggtatgcaaaggttatatcgatattaattgtagcgttaatctgtaatatttatagttttattaccggattgtttgcattaaacgggggaagtgggtataagtcagtaccttatttagaattatatggtcatttctttaaatcactgtcattagatttagtttcaatgtttattgttaactatattatgttggttatgctagccgtctttggtatcattgcgggagccgtctttgcgctattaacacggaaaaatcaaaaaattgtggcaatatcaatccctattttaggaatcctgttattagcgatattggagagaatagttatacgacaatcgcatatattagacccgttggtagcattcttaaaatttgctatgggttattctaaaactttaggttactttaacccaatcattccagcgacaggtatggtaatattgattgtattatctttgataatctcaagatggttaaatacattattacgtactaaacgaggagaatgacttttatatggatcagacaagcaatagaacattaaagaaagaagtcctagaactctatcggggaaactggataacagcaattaaaattaacattataccaattgtttgctccatttttagtggatttataattgctagtttgattggaataattttatatttttttagtcagattgatagcagcgcactaggtacaatgggaaattacagtcaaaattcagggaccccttattcaggtaggacgactgctcaacaatttttctttcaagcaatcgtagtattttttacagtgggaattcaatacggaattttagattggttacgacaccgaaatcagcgtctttcatgggggacagcccttcaaacctttagcagaaagtattttacatcaactctagctatttttatttttcaatttattttccgcttcttatggtccttcttgctcattattccgggttggatcaaatattattcgtattcacaagcctattttctttataaagaagccactgatcggaagataagtgatcgttttgaatttgttaatttcattacttttagtcgacgactcatggatggcaataaggcaagattactgggattacaaatttcattaattggatggtacattttaagcatcattacgtttggaataggatttatttggtacgttccctatcgcaacgggctttatgtcgcattttataaaaatttagttgaacagcgtggtcaacaagttcttccagaaatatttggatgacaaaaacgcatctaaacttagcttttaactaagtttagatgcgttttttaatctgtagtatgtcttgctccgtagaaagtgtaaacaataattccaatgataaaccaaactagtgagtataatttagcttgggcgtctagtccccagaaaactgccagagagcctaagaaagccaaggcaggaagaacagggtagagcggcattttgaagcttggaatagcaatatccttaccttcacgtggtcgcaggacatagatccctaacgatacaaacataaaggcgattaaggtcccagctgagattaattgcgctaagaaagcaaaaggaaacatggaaccaataataatgccgataattgttaaaaggcttaatgcatggttaggaagaccttttggatttacttgacctaaccatttaggtagcataccatcacgtccaaatgagtatagcagacgagaaccagccatcatcatgccaattaacgctgtaaacatcccaattacggcaattgcttgaatcacaccagcaattactccatgaccagcgtgtcgtaaagcccaaccgacaggttcagcattattagcgtaattcgtgtaatgaaacattccaactagcactagcgaaactgcaataaaaaggataacagcaattattaacgatcctaaaataccgcgaggcatagttttttcagggtttttagcttctccggcattagcagcaattgaatcaaaaccaatataggaaagaaaaatcattgaaattcccgaatagatacctttccatccaccaaaggaagttccgtctgggttggtatgatatttagggataaatggtaggtagttttgaatatggatagctgaaagtcccacaataataaatactaaaatagcaacaacctttaaaacaacgagtgcattttcgatgcgagcggctcctgtagttccatgagctaaaagtaacgctaccgcaataacgacgatcaacgcagtaatatcaatgattccaccattagtacctagaggatttgcaagttgtttgggaatttggattccaattgaggaaagcagtcccctaaagttagctgaaagtccggaggccacgaaggctacggcgatgaaatattccgctaacaaagcccagccggctacccaaccaaaccctttacctaagattacgttaatccaagagtatgcagatccagcaaatggcatagcggaagccatttcggcataagcaaaggctactaggccggcaactacagctgctgctaagaatgaaagtacgacggctggaccagcatgttgagctgcaaccacaccaggaagtgtgaagatggaggtggaaacgatcgtcccaaccccaagagctaaaaagtctttgactactagggtacgagtcaaatgagaatctttatcttcataaatagcaggattttcttttttaataaaatttttgatgaaattatgcaataatttaacctccttaaatagtagtatagactatcatatcatattctatcatttgtttttaatgtttagctaatcaaatttaattgtatttttaagtgaagaatgggaaatatttttgctaagttgatgaacgtgttagaatcaatatattattaggaggacatgcctttggattcaattaatgaaacacaaacaaaaatagcagctctaaggatggatctccgagttggaaaaatattttcttctttaggaaaatcagttggactaatcattgattcggcttcacaagatttaccagttactgaggtaaaagtcccccaagatgaagatgatgtagttgaattacttaaaattattaatgaacagttggggaagggagacatggacgaaattagtgatgataatattaatctactaatggatcacctaggctcttttaaagctcaaatccgtgatagtggagttttcactctttttggtgatttactccaatatgatattttaactaaaaatcaaaaaataatgatatttgatcgtttgattagtgaccagatgctcttgtcgcatattaatgaaacacagaatgatgcggcatatttaagagcatacacactaattttgttagcaactcttatctacattgatcgagctgggaccacttttattgatcctaaacgtcgatcaagattggtaaaccaaattgtactctatactatgctagaaaacgatacacgtggatatgaagacgggcgaggatggattcatgcctatacacatttgggtaacgttttagatgagctagcaagtgatgaaaagttagtccgagcggataaaattttattaatgtgtacagtgattgaaaagataaaaagattaaaaacaccgttaatttatggagaatctattcgtttagcggtatacattgccgaccaactatatgaagacgacgtatatcagcaatttttattgattgaacttcgcgaatggcgtcgctctttggaaacaattcaaatgagagagtccagtgctatgtggaatgctttatttaatcgtcagcgttttttgcaagccctcgttttaaatccggatatggccaattcaattgtggaatatttggaagattccaatgattttacagtataatttttaacttctatttcatcattgaactgattttatgatatactgaaggttcaataaacgtttgataattggcggagcaaactcaaggtttgtaattatcttacatacgaggtggaaaaaatgaaaattgctgtacttgccggtgggaaaagcacggaaagaaacgtgtcgctttcatctggttcaaagatcaccaatgctttgcgatcaaaaggttacgatgcaacgatgattgatttattcttgggatatgaacttgagggtggtcaaagttatgaagacgtatttaagtctagtaataccagtactgattatgaaatcagtgacgcagttttaacagaagaagatattgaagaacttcgtacagacggtacggttggattgtttgggaaaaatgttttaccaatcctccaagctgctgactttgtttttctagcgttacatggtggtgatggtgagaacggtaaagttcaagctgttttggatcttaatcatattaaatatacaggtagtggttcactagcttcaggaattgccatggataaagcaatttcaaaagagattatgttgtataacaacattaaaacagcccaatttgctgtattgcatgcaaaagatggtattcatcctcaattagcctttgactatccaatggttgttaagcctaatagtggtggttcaagtattggtactagaattgtgcatgatgaagccgaactagctgaatcattaaaggatgcctatcgttttgatgatgaaattattgtcgaagaatttatcactggacgtgaattttcactaggggtggtaaatggtcaagcaatgccagcaattgaaattgtggtaaatgatggttggtacgattatgaacataaatttcaaacgggttcaacgactaaattcgttactcctccagaaatcgaagatgatgttcatgatgaaatgaaaagggtagctgttcaaacaatggatgccttgggcatgactaactatggacgcgttgattttctaactaacgacacaggcgtatatgtaatcgaagccaataaccttccaggaatgacacctctatcgttattaccacaagaagcagaagcagctggtattagttatgaggacctttgtgaaagtatcgtattaggcaagcaaaagctttacgatgaattaaaaaaataaatttaaaatccctctttagagtaattaaaccctaaggagggattttttatgaaattaaaatgtacgtggtcaactaagaatgcaattttagaaaactatcatgataagatatggggaaagccatgttttagtgaccaagaactctttaaatgtctggcaattcaaattttccaatcggggttagatttacgaacggttttgacgaaattggaagcattaaatgaaatgtttgacgagtttaaagttcaaactgttgctggctatgatcagtctaaattagaagcgttgatggcatgtccattaatcattagaaaccaacaaaaaattaaagcagttatccataacgcagatgtgatcttaaaaatgtctcaaacggggatgtcttttaatgattttatctggtcaaaagtagattttgttcctatggatttagaacccaaaaataatgctaaaatgatgtttgatttaccaattgctagaagggtgtgtaaggacatgcaagagctgggatttcagtttgtggggcctactaacattagcttctttttacaagcaagtggaataattaatacacactgggtaaattgtagttatcgttaaaatggcgtaaataaaaagtacggcgatttaattttttaaactaaattgctgtactttattttattatttattttctaagtctgtgcgaacaaccaaaacatcacaaatggcggtacgggttacgtattcggtaacggaaccgattaataaacgttcaacagcgtttaatccagtagcaccaatcatgattaaatctgtatgaagttctttagggacatcttgagagattactacctttggtgaaccgtactcaatggaataagcaacattttctaatccatcattgtgtgcctcttggatatagcggtctaaagattttttagctgtatctgtgacttggtcgaccatggcggtatcgaaactcgaaatattttggaaagcacgagtatctataacgtggagtaaatgcaattctgcaccatcgttacgcttagcgacggcaactgcttttctaaaggctagctctgcttctttggaaccatcaactggaacaagaatatgtttatactgttgtgtcataacataaccactcctatctatttaccctcattgtacgttaaaaatgagaaaataaaaaggaatttgctataaaaattttaataaaaatagcaaagttccagtggtagaaaaaattcctaaaactaaagcaattaaaattagaacagtatttccagttattcctaacagtagagtaataatactaatgcctattaatatttttccaactacatttaaactttggctgagtaatttattagtagaaggtttaaatagcataaaatccgtggaacggtgggtatagaggtaataaccgatataaaagataataattgcaaaaatgaacataaagagctgaattagcataaataaatcctactttcttaatatataaaaaaaccccaccggagtggggcaaagaacttttagtagcgttcatatcggccagtatctaaccctagtaactaggtgggtgcacatacccaaacagcatgtttccttatacaaggcatacaattcacttgagatccgtgctcccgattagatgtttgttggaagaatatgaaaccgataattccgaatacctaagaacttcataattatcttactatactttttgtagaaaatacaatgttaatgattagaacgttgtgatttctttagactttcgtaccgatttttaattttctcttcataggtactattacctttggcctcaaaatatgcagcatcaaccaatttgtctggtagatattgctgagctatccagtcattaggataattgtgagggtatttgtaatctaccccacgacctaaagcagctgcacctttgtaatgagaatcgcgtagatggtctgggacttcaccaatctttcccgtacgtacatcggttaaggcattatcgattgcggtaatgcctgaattggatttaggagagacacaaagttcaatcacggcgtcagccaaaggaattcgagcttcaggcagtccgacgtgttcagcggccgtgacggcagaaactgtccgttgacaagctggggggttagccaaaccgatatcttcataagcaatgattaacagtcgacggataacactttgcaagtcgccactttccaaaagtcgtgccatataatggagagccgcatctgtatcactaccgcgaattgatttttgaaaggcagaaattacatcgtaatgagcatccccatccttatcttgggtgagagctcttttttgcagacattcttctagaatagctagtgttaagtgaattttttgattttcgtcaggaccagttgaacgcgcagccagttcaactgcatttaaggcgctacgcaaatcaccattagtggactcagatacaaattttaaagcatcttcatcaattacgatgggtaattcacctaaaccacgggaggaatccttaatcgcagcaaggacagcttctttaatttcatccggttgaagtggtttaacttcaaaaatttgagttctactacggattgccggattgatattgatataaggattttcagttgttgcaccgattaaaatgatattgccattttctaaatgggggaggaggaaatcctgcttagttttatccaagcgatggatttcatctagtagcagaattacagttccactcattttggcttcttcagccacaatttgaagatcttttttagaatcggtggcagcgttcaaaattcgaaaagcatatttagttgagcctgaaatagcactggcaatactagttttaccagttccaggaggaccgtataaaatcatggatgataaaagtttagctttaaccatgcggtcgataatttttccaggaccgaccaaatgttgttgaccaacaatttcttcgatagttcgtgggcgcatacgaaacgctaatggttgcattttttctcctaaaataaaaatttaaagtaaataaaaaaaacggccaaggccgtttttaatatgattatagcttgttgtagtattcaacgataagtgaatcgtcaatatctgcttcaagttcatcacgttgtggaagacgaacaagagaaccttccaacttgtcagcatcaaactgaacaaattgtggacgaccaacaacagcttcaacagcttcgctgataatcttaagatcttttgatttttcacgaacgccaataacttggccgatttctacttcgtatgaaggaatatcaacacgcttgccatcaacagtgatgtgaccatgatttaccaattgacgagcttgacgacgagtagttgccaaacctaaacggtaaaccatgttgtccaaacgacgttcaagtaaaaccataaagtttgtaccaggaagaccttcgcggatcttaccagcgcgaacaaataggtttgagaattgacgttctgttaaaccgtacatcatacgtaacttttgcttttcgcgaagttgcataccgtattcagaaatcttacgacggttattttgaccatgatcaccaggagcgtaaggacggcgagccaattccttacctgtacctgttaatgaaataccaagacgacgtgaaactttccagcttgggcctgtatatctagacataaaaatatcctccaataaattgtttttgttggagtaaaataaacaaatgtgggtttagtattcgtgcagattgctttgcaaggttcacctttgcagccgctgaggttactagttgacctgaaaaacaggcaacaatctgttgacgagcttaccgcccaccgctgcattattttacactcctactagtttaacgcactcaaaacagaactgtcaatgtgtttaactaatgcgtctctgaatttaatcagagtggcttcatcatcttcactaaaacgattgagaatcggtgagtcaatgtctaaaacacccaataattggttatccatcattaaaggtaagacaatttctgagtttgatgcactatcacaagcaatgtgtccaggaaattcatgcacattttccacacggagtactttattttctttaaaggcagttccacaaactcccgaaccgtttttgatgtgcatacaagccacatttccttggaagggtcccaggaacaattcatctttttttgaatcaaagagataaaaaccacaccagtttacatctttggtttcgctatacaacaaagctgaagcatttgaaagattggcaattaagttggtttcattaaacaaaagtgcatcaatctgttcgacaataattgagttaatcggttctgacattgtagtcacttcctatataatgtttaattaataaaaaatccctagtttaacaaactaatgggtatgatataattaattaggtaaattctaaattgaagaaagttaaaaggcaagttttttatcaattgaattgagtgaagttaagaaggatgggattttagttatgatcatggtattgattgcaatcatagtggtagcaattctagtttatttaggaattgtttcatatcaacgttatttacttaaacaaatcgatgaattattagatcgaaaagcagacatcagtgaatcaccggtgcgtcaaaaactaatggaagtttcctccatgaatctaactggatcatcggctattgggttagataacattcgaaatgactaccaggaaattattgatcatcgattaccagaaattgaagacattgctaaccattcgaaacaagatatcaatgatatgaagattttcgaagcgcgtaaggatgttacgacggttagtgaatctttagatgcaattggcgaagaaacgcgacgtcttaacgatcagttggataatattaaacgtacggatcaagaacaacgagatgcggttaaggtcttacgcatgaagtatgaagaaattagaaaaacacttctagctaagaacctaacgcttggtccaagcattgatttattagaagaaaaattagctcgtttagatgatgaatttgaaatgttcagtggaaccgtagaagctggagatcatgaaaaggctgaaggccaactccaaaaacttcgaacaagtacagaacaattagaagcacaaattcaaaacgttccacctttatatgaagaactaactaatgtatttccagagcaaattgctgaaattaaagatggctacgatcaattgattaatcataactatgcctttgaagatgatatcgttgatgacgagctgggtgctattaaagctaagatttcagataatcttgaaacccttggtaacttacgtttagatgctgtacgtgataacaataagtcaattgaaattagaattgacgatttatacagtatcttacaaactgagattgatgcacgtaagtcagttgaacataattttgatgtaattactcgcttcttaaatcacgctgaaaaacagaataaagttttgttagcagaagtggaacgtatggatcaaagttatgttttgagtgatgatcagttagtattaggtcaaaacttagatgctgaattaaatgaaattcgtaatgaacatgatcgtgatacagaacaaattactaaccaaccggttgtttactcagaaattgtggaacgtttaaaagctgaaaatgaccaactttctgagattgaagatcaacaagctaaattaaatgatgaacttcaaagccttgtagatagtgaaaaagatgcccgtgcaagaatgcaacaatatgacggtgaactccataacatcaaacgtcacgttgaaagtcttaaccttccaggtattccagaaggatacatggattacttctttgtggttagtgatgagattgaaaaagttgggagcgatatgaatcaagttcgagttaatatagacaagattaaccgagaacttgatatggtaagtacggatattcaaactcttactaagaagaccactgatctgacagacgatgccgctatcagtgagttagcaattcaatacgctaatcgttatcgtcatactgatcaagatatcgaagacgctattttgcgagctcaaaagctttttgatacggaccatcgttacaatgaaagtttaactgtaattacaaaagcactagaagaagttgaaccaggtgcagtggataatatcacagacaattactaccaacaaaaacgaactgaatattagaaaataaaatgctatcgtacttagtgcgatggcattttactttgaagatctaaatatttagattactttaattttgtaagtatatttttctgttataattattagggtttacggaaatatataatggagaaatgagtaaatgatttattttgataatagtgcaacaactaaagttgataagaacgttttagagacctaccaaaaggtcagtaataagatttggggtaacccttctagtttgcatgatatgggcgaaatgtcgttcaatttattggagcagtctagaaaacaaattgctagtttgttaaatgttaaacctcacgaaatattttttacaagtggtggaacggaaggcgacaactgggtaattaaagggacagcgatggaaaaacggatgtatggaaagcatctaattgcgacggctgtcgaacatcctgccgtaaaaaattctatggaacagttagcacaattaggatttgatattacctatcttcccgttgatgatgagggtcgaattaacattcaagatttaaaagatgccattcgcccggatacgattctggtttcgattatggcaattaataatgaaattggaacaattcaaccacttttaaaagcagcagaagttttaaaagactatccaaaagtacattttcatatcgatgctgttcaaggaattggtaaagggattcaagccgcaatcatgaatgatcgtgttgattttgtgaccttctccgggcataaatttcattctcctcgaggggtggggtttatttatgcgcgcgaaggtaggcgaattgcaccattgttaactggtggtggacaggaaaagaatttacggagtggaacggagaacttacctgcgatcgctgggatggctaaggcactgcgtttactacttgatggcgaagatcaaaaggtagctttacaagaatcaattaaagagaaaatttataatcacgtaactaagtttgaaaaagtggttgctttttctaaaattcaagctaactttgctccgcatattttgtgttttgcgattaaaggggtgcgtggagaaacgattgttcatgcgtttgaatcacatggaatttacatttcgaccactagtgcttgttcttctaaaaaacagcaagcttcaagtactttaacggcaatgaagattgactcaaccatttcaacgagtgccgttcgagttagcttagatagtgctaattctttggaagaagctgatgaatttaatcgaatttttgaccaattatatcaagacttttcaaaaataaataaaaatagctaggagtttatatgaaatatacggaaataatggttcgctacggtgaactatcaactaaaggtaaaaaccgcaaagattttattgctcgtttgggaggaaatatacgtaaaagtcttaaggactttgaagacgttgaaattcatcctaatcgtgaccgtacacatgtaaccttaaatggtacagacagtgatgcagtcattaacagacttaaaaaagtttttgggattcaaaatttttcgccaatgttaaaagttgagaaaacaatggaagctgtccaagctggtgctctagaaatgatgaaggagcaattaaagccgggaatgacctttaaaattaatacacgtcgttctgataaagaatttgctattaatacagataccatgaatcgggaacttggtggatttatactagataacttcccagataatgatgtaaaaatgaaaaatccagacattaccttacgtgttgaaattcgatctaatggaattttcttaactagtgaagtaattaatggggcaggtggcttaccggttggaactgctggtaagggaatgatgatgctttctggtggaattgattctcctgtggcaggttatttggggatgaaacgtggcgtagagatggaaatggtgcattttttcagtccgccatatactagcgaacaagctctagctaaggctaaggaattaagtggaaaattagctgcatattctggaagtgttcaatttatccaagttccatttacagaaattcaagaaactattaaagaaaaatgtccagagggttatttgatgacgattcaacgtcgaatgatgttgcgcctagtagttgccctagctaaacaacgtggtggactagcaatctttaatggagaatctctaggacaagtagcttcgcaaacaatggaaagcatgttagctattaatgacgtaactactatgccgattattcgtccggtagtttcaatggataaaaatgaaattattgacatagctaaggatatcgacacttatgacttatcaattatgccattcgaagattgttgtacgatttttgctccaccatcacctaaaacacatccagatctcgaaaagacgcgttactttgagaagagaattgacattgaaggattattggaacgttctttagcaggcgtaaaaattactaacattcgtgctgaagaaaactttatgaatcaaaatgaagaagtttttgctgaattattgtaaaggatttgtatattgattgaaatcagtgagtgtttgagataaggttaacgtaatttaaataaaggagcgtacaattatggaagtattacgcggtggagaaaaagttgaactcgttggaaatcctccaatgattggagaacaattacccaaatttaaagtttttactggcgatggtgaaaaagttaagacacgcgatttactgggtaaaccacttttaattagtgttgttccagatttaaatacgccggtttgcagcatgcaaactaaaaaatttaaccaagaaactgaccaatactcagatattcgatttgtaaccatttctaacaacatgcttaaagaccaagtagcttggtgcgcaaatgaaggtgttaagaacatggaagtattgtcagatcatgagctatcatttggttatgagatgaatctatatattccgaatgctggttatctagctcgtagtatcttcattgttgatgctgatggcaaaattatttatcgtgaaattgtaccagaaattcatgatgaacctgactatcaagctgcacttgattttatcaataaaatgtaaaagaataattgacgaacggacaattattctttattatttattctgaaggttatgactaagaggagagctgcaaaacttttttcagagaatagacatttttgctgagagtcttaaaaagttggagttcgggttgcttatgagccaattttctagatttaattctagaaaatcgaacaaattgttcgttatcaatgttaaagaggggcataatacgcccaatttaggtggtaccgcgaagcatcttcgtcctatgagttaggacggggtgctttttatttggaaaggaaagtgggattttaatgactaaagacgtagatatgtcgacaaagtacgacccccaaagcgttgaacatggacgctaccaaaaatgggtcgaacaaggacaatttaaacctaatggagatcaaaaggctaagccttattcaatcgttattccgcctcccaatgtaactggaaaattacatttgggacatgcctgggatacgacactacaagatatgttgatccgccaaaaacgaatgctaggatatgatactgtttggattcctggaatggatcatgctggaattgctactcaagctaaagtagaagccaagctacgagaacaaggtgtttcccgttatgacttaggccgtgaaaagttcattgaccaagtttgggaatggaaagatgaatatgccgatacaattcatcaacagtgggctaagatgggtctttctcttgattatgaccgtgaacgttttaccttagatgaaggtctttctaaagctgtcaagaaagtctttgtgaccctttatgaaaaaggcttaatttatcgtggtgaatacattatcaactgggatccacaagctcgtactgccttatccgatattgaagtggaacatcaagatgaccaaggtgctttttatcatgttaagtacttctttgcagatgaagagtttgaatttaacggtaaaaactatattgaaattgcaactactcgtccggaaactatgtttggggatgttgctattgctgtacaccctagtgatgaacgttataaagatatcgttggtaaggaagtcattcttcctctccaaggacgtcatttaccaatcatcgctgaccaatatgttgacccagaatttgggacagggatggtaaaaattacaccagctcatgaccctaatgatttccaagttggtaatcgtcatgatttgaagcgtatcaatacgatgaatgaggatgcttcaatgaatgaaaatgctggtaagtatgaaggtatggatcgctttgaagctcggaaagccatggttaaagatcttgaagaacaagattacatgattaagattgatccaattgttcatagtgtgggccattctgaacggacgggtgtgcaagtcgaatctcgattatctacccagtggtttgttaagatggataagttagcccaaatggcgctggataaccaaaaaacagacgataaggttaactttattcctgaacgttttgaacatacctttaaccaatggatggagaatgctcatgattgggttatttcacgtcaattgtggtggggacatcaaatccctgcttggtataacaagcaaactggagaagtttacgtgggcgaagaagcacctcaagatattgaaaattgggaacaagaccccgatgttttggatacttggttctcaagtgctttatggccatttacaacaatggggtggcctgatgagaattcagcagattttaaacgctacttcccaactagtacattagttactggatatgacattatcttcttctgggttgctagaatgattttccaaagtctagaattcactggccaacgtccgtttaaagatgtgttacttcacggtttaattcgtgacgagcaaggacgcaagatgagtaaatccttgggtaatggtattgatccaatggacgtaattgataagtatggtgccgatgcgcttcgttggttcttatccaatggttcaactgctggacaagatttacgctttagttacgataagatggattcggcatggaactttatcaataagatttggaatgctagccgttatgtaattatgaatttggatcaagttgaacagccaaaacttccggaattaagccaattaacattagctgataaatggattttgagtcgtttgaataaaacggttgaacaagttacgcacttctttgacgtttatgattttggtgaagctggtcgggcaatgtacacctttatctgggatgacttctgtgactggtatatcgaaatgagtaaagaaattttgaacggtgaagatgaacaagctaaggttaatactcaaaatgtattggcatatgttcttgatcaaacacttcgtttgttgcacccagtgatgccatttgttactgaaaaaatttggctctccatgccacatgatggtcaatcattagtgaatgcagaatatccggttgtacatgctgaactagaaaatcaagatgctgaagcgggaatggatcacttaattggattgattaaggcggttcgtaacattcgttcagaagctggggccccaatgtctagtccggttgatcttttgattaagactgatagtacaaaactaatgcaactctttaatgaaaatcgcgattatattgatcgtttctgtcatccagctaattttgaattaggggcagatgtagaggcaccaaaactttcaatgtcagcggtaattacggacggagaaatttacattccactagctgaattagtaaacttggaagatgaaattgcgcgtctggaaaaagaagaagctaagtacgaacaagaagtaaaccgtgtggttaaaaaattacaaaatgaacgttttgtaagcaatgctcctgaagaagttgttgcagctgaacgtgcaaaacaaacggattacgaaggtaaattagaagcaactaaacgtcgtcttgcagatattaaatctgaaagcaagtagctaacgtttaaattaacattaaagaactgcaaacaaaaagtgatttttgatgcggttcttttttgctagaagggggctcagtgatggattataaaacggctttggaatttatacacggacggccgcggttacgaaaagagccgaccgtaaaaagaatgactgcctttctagatcagttagggaatccccaagatgcaattcaaggaattcatgttgcagggaccaatggtaaaggttcgaccattgcttttttggccaaaatgatgggggctgctggacgacaagtagggacatttacttcgccttatttagaacgcttcaatgagcggattgcagtaaatggaagccctatccgtgacgatgagattctaacgttagtggaagaaatcaaaccaatcgtagacgagttagatcaaacgcccttaggtggaccattagaattcgaaattgtcacggccatgatgtttttgtattttaaaaaacaccccgtggatatagttttgattgaagtaggtattggaggaaggtatgattctacaaatgtcttcaccccgattgctagtgtaataacgaatattggttgggatcatatgcaaattctgggtgatacattacctaaaattgcttttcaaaaagcaggcattattaaaactaatgttccagtaatcactggaactgaagatcaggctgcgctacgagtgattgaagaggaagctaaaaagttacacgcaccgctaaaaattttgaaacgtgattttaaaattgattccaaggaaaattttttcagcaatacgttcgctcaaatcgatcatattcacagtggcttactgggtttatatcaagtaaataatttggcagttgctctagaaactatgttagtagttagtcgtcaattaaattggaagattaactatgatcaattacgacaagcagtccaacatactcaatgggctggccgaatggaaattattcaaaaacggcctaaaattattttagatggggcccataatttaccaggaatccaagcattaaaaaaatcgattcaagcgtattggccagaacaaaaagtttttattttagcagctattttagatgacaaaagatttgaggcaatgttgaccgagttagttgatttaaaacaagtagagttaacgttaactagatttaatgggccaatcaagcgtgctgctgtagactggtcagaactgcacgatccgattcgaaaagatattaattatcaagcgaattggcagtcggctttaaaagaaattttgcgtcaggctaaacctagcgacgtaattattattaccggatccttgtattttatttctgaggtacgcccgcagctaattaaataaagccggctgaatttccgtatgtatttaattagaggtgatgtatatggaaattcaagatggagcgaaagcaaaattaaaaaaagtcggtgctgaaaatttaagtaacgaagaacttgttcgagcttttttggatagttttggacaaagtcaaaaaattaaccagctaactaatcatttttgggatacaattggagacatagctggttacggcttactaagtcaaaatgaaaaaagaaaaatttttaaaaatcttccagatgctactgtagctttggagacgggtattgaattgggacgtcgaattcaaaaacaaccaatccatttactgggaaaggtactaggaagcgctcagttgggacaaatgatggtttcaagatttcaaaaggaaccgcaagaacacctgttggtattatgtttggatactaaaaatcaaattaaacgcgaaattgttgtttttaagggtggccttaactcggcagaagttcatcctcgagaaattatggtggaagtattgcgggttagtgcaaatagttttgttttaatccacaatcatccaagcggtaatatagagccttcaaccaatgatttagccttcaccaagaaaatgaaaaaagtcggcgatttaatgggtattcgcctaattgatcacttaattgtaggagatcaaagttactggagtgcagcagaaaaaagatttatttaatgattgataaacatttaggttattgcctagtttataatctttatatgttataatttatgaagtcattttaatgagataagttaaggggttcagggctcatgcataagtttttttctaatcgaaaattagttataacagtgatttgtgcaattatcgcggtaggtttaattgcaggttcacttacattgaaaaagaaagataagacgcctgttattcaaaaagtcggcaacgacgtttttggtacagttagtcgcgtgattgcattgccgattcatggtgtacaaacaatgaccactgatattaacaactttgtttcgacctacgaagaaaacgcacgtttgagaaaagggattgaaaaaaatgattcaatcaacgccgaaaataaaagcttaaaggctgagaacaaagaattaaagaaactagttggcctaaaagaaaccatgtcggactattcactaacagcagcaaccgttttaacccgttcaccgagctcatggcaagatttaattacggtaaacaaaggaacggctaatgggataaagaaaaatcaacccgtcttagccggtaacggattagttggtcgggtagtagaagctgattatacggtaagtaaagttgaattgattagtgataataatgaatccgctaatcgttttgccattcaggttcaagcaactgacggagaatatattaacggtattattactggctatgacaaaaagactaaccagattattatgggacaaattacggataaaaagacggttaaagttggaactccggtaacaacatcaggtcttggaggagttactccaaaaggactgtatgtcggaaaagttgctaaaatttcaaaagatgattatgggttagctagcgaaattcgaatcgaaccagcagctaaattaagcaatgttaacaacgtttatattgctaagttagattagggtgaaagcatgttacaatctgcaaaattaaaatatatttttcctatcgttttattgattgctttttttctagatggttcattaaatcaaattttttcgtcaactttatttcaatatccatattcgatgatttgtaatctaacgttgatgtggtttgtaatggcgatcttttttgaaggagaatctcaaattaatttcacattgtggtcatttgttattgggattatatttgattggtattatactggagtttttggcgtggatacttttattattccaatcgtagtgatgtttattcgtggaattcgaccttttgttaaaacaacattcttgatagtgttggggatggatatgtttgcgatggcgatgtataacatcttatttttcatcgtttttcaaatgattaagatggcgaatgtgactaccacatttttcatcggatattcgtttttaccaaccattattctcaatttatcaatttttgtaattctatattacccaattaaaaccgtatttagaagaacacggggaaccaattcaagaagttttatgtaataaggacttgaaagttttaaatataattgatattatttgtatactttagcaatgatcagaaaagtagtttatgtaatcttcgttaagcgagccgtggacagtggaagcatggtcaagaccataaatgaaacacatctgtaagttgataacttgaacaattaattagagttatccggtaattccgttatcatttaagttaattaactttctgaggttggttgcgtgagcaatcaacaaacttgaggtggaaccgcgattgaactcgtcctcttaggcttttggcctaagaggatttttttatgggttgggtggtgtgctactaaagaaggttaactaactttctgaggttatttatgtgagtaaataacgaatcaggggtggaaccacgattgaactcgtcctcttaggctttttaacgcctaagaggattttttatttattgaaaaggggaatagcgatgtttaacattaattatatttcagaaattataccatctttgttaagtggggcatcaatgacattacaggttttctgttggacaattgtggggtcattaattcttggtgtttttctagcgttgggtttagtatcaaaatttaaaccattccaagcaattataagtgcgtatgtgtggttaatgcgtggtactccattacttttgcaattaatttttattttttacggattaccaactgtgggaattgtatttccacgctacgaagctgctttactagcttttatcctaaactatgcagcctattttgcagaaatttttcggggaggattacaatccgttgataaaggtcaatatgaggcgggacgggtacttcagatgacctattggcaaacaactaagaaagtaattttgcctcaggtcgctaaaattgttctcccatcaatcggaaatgaagttatcaaccttgttaaagattcgtcattagtttatgtgattggaattggtgacttactacgtgcaggaaatgtagcagcggctcgtgatgtgactttggttccatttatcttagtcggtattatgtacctaatattgacagggatatgtacattcctgttacgtaaagtcgaaaaacactattcatactttaaatagggagggattaggttatgttagagcttaaaaatgttgttaaaagtttcaacggtaaaactattatcaataatttgaacttaaaaattcaagatgggaaaatattaactattgttggtccttcaggagcgggtaaaacaacccttttacgttgtattagcgggttagaaaaaattgattcaggtgaatttcttttagatgggcaaccgtttgatccatatgaaagtcgagacaatgaaagtgtaatcggagttgtttttcaagattttcaattatttcctaacttatcagtaatcgataacatcacgctgcctccaatcaatgttttacatcaaaaagaaacggaagctaaagaacgcgtgcaaaacattattgaacgccttgatttaactaaatttgtagaacaatatccatatcaactatccggtgggcaaaaacagcgagtagcgattgcaagagcgttagcgatgaaccctagtattctttgctacgatgaaccaacttcagcgttagatcctgaacttcgaaatgaagttagtaaattaatcttagacttgaaggaaaatggtattacacaagtaattattacgcatgatattgaatttgcagataaagttgctgatgatactttaacagtgaagccggtggattaaatgaaaaaagaattgaaattatttcttgtgatggctttgggactattaattattccagttctaggaggttgtggcaattcaaagaaaaccactagggccgaacctagtagttgggaaactattcaaaaaaataaaaaagtcgtaattggcttagatgatagttttgtaccaatgggatttcgagaaaaaaatgggcagcttgctggatacgatattgatttagctagagcagtttttagacaatatggaattaaagttgattttcaaacaattgattggtcaatgaacgtaactgaattgcgcaatcaaacgattgatttgatttggaatggattaacaatcactgatgaacgtcaaaaagcgttgacgctaagtgagccttatctaactaatcaacaaattatagtagtaaagaaaagtagcgggattaccaagttagcagatctgaaaaataaaagtgttggtgcacaaagtgggtcatcgggtgcacaagatattgatgaccatccccaaattttaaagaatcggattaaaaaccacgaccctattttatatgatagtttcaataacgcgtttattgatttgaatgctaaccgtatccaagggttactaattgatagtgtgtatgctaattactatattaagcatatgtcgaattcaagtgattatcggattataaagagtaatatgcccagtgaacaatttgcagttggaattaaaaaaggcaacactgaagttaaacaaaaaattgatcagggaattaatcaattaagggccaatggagaattaaaacgtatcaatcaaaagtggtttggaaaataatctgaaccttaagaccgaaaatttagttattttcggtctttttgatacactggagaaaagaatggcggaggaagatcattttggttcttattgagattgttttttacctaatcaatattatcatcgcgttaacgatcgcattaatggaaaagcgagatatttctgcagcatgggcttggttatttgtaatgctattgcttcctggaattgggtttataatttatctattttttggctggaagttaaatcaaaggcaaatatttgatttgaaagctcaaaaaagactcggaattagcgatatggctgaatatcaaaagcgtaatcctaaaaacaaaccgaccctggataccaatcttgaaaatgacttggttcagatgtttttaaacacggataatgcaattttaacgactaaaaatgatttaaagatttttacagatggtcatgaaaaatttaacagcttgtttgaagatttaaaaaaggctaaacatcatatcaatatcgaatattttacaatctatgatgatcagttaggcaaaaaattacgtaaaattttggttcaaaaagcgcgtgaaggtgtccaagtaagggtgttgtacgatttatttggatcaaaaggatccaagcaaaaattttttaaagaattaattcaggctggtggcgaagtcacgccatttatgaaatctaagctaggctattatagttttagaattaattttcgaaatcatcgaaaaattgtggtgattgatggatcggttgggtacattggtggttttaatattggtgaccaatatttaggacgtaataagcgctttggaaactggcgtgatacgcacttaaggttagagggttccgtggtattgcaattgcaaagtcgtttttttatggattggaatgcatccgctaagcgtcaaaaagttcaatttagcttagattattttccacaaagtaacgttcaaaataatattccaatgcagattgttagtagtggacctgagaatgatgttcaaaaaatcaaacagggttatattaaaatgattatgggggctaaacattccatttggattgaaacgccatactttatccctgatgatgccctaatggaagctttgttaatcgctattcgttcaggcatcgaagtgcggattgtaattccacaaatgcctgatcatcccttcgtctaccgggctacagagtattatgtacaacaattgttaaaagctggcgcgcgtatctattcatatcaaaatgggttcatgcatgctaagacgattgtggtcgataatatgattacaagtgtaggttcagcaaattgggatattcgttcttttaaattaaattttgaagcaaatgcatttatgtatgatcctaaagtggctgaacaaataatcgctacaattaaaaatgatttaaaggatgcgcgtgaattggatgaagaatatttcaagcaacaatcttcgtggaaaaaattccgtcaattggctagtcgtttgatttcaccaattctttaattaacattgaaaagtgtgcgaaatttcgctaacattaatcgcatgtgaaaaagtaggaggcatcatattggatgttcaaaatcagtctgggattcagactttagttttaccaagtaaaaaatttaaaactgtgcgcattgacgtacattttttgaaatacgcaacgattaaagatttagcccaacgctctttaattgctaatattttagatacaagtactaaaaagtatccagatcaagttcggtttacgcatgctctatcggaaatgttcggcgctagctttggtggaggtgctgctaaaaaaggtaatatgcatgatgtggctttctcaatggtagttgctaatgataaatatataaagcgccaaaacttaattcaagatgcgattcgctttttgaatgaagtgattgttcatccactagcagatggtaagcaatttgatgaagaaacattccaacgtcaaaagcaaaatatgttaaattatgttaaatcggcaacagaagataagcagtattggtctgcacaacaattacgtaaactaactttcggtcagaccgtggtacaaggtattccaagctatggattagtagaagatttagagaatctaaaaaatgcagaaacctaccgagcttatttggatatgcttaaaaatgatttagtgcatattagtgtttcaggggacgtcaatcaagaagagattgaggaagatttaaagatttttgaattagatgaacgccaatttgatttaaaacctttaattacacatttcgatgcacgggagaaagctatcgttaaggctgaacatcaagatgtacgccaagcacgcttaaacttatctttcaatattccggctgatatgactggagagaacttttttacggcagtcgtatttaatgctttattcggcggatcaccacaatctaagttgtttgttaacgtgcgcgaaaaagccagcttggcctactatgctagttcgagtttagatttatatgacggaatcttaaatatccagacaggtattaatggcgggaaccatgatgctgcaatgcaaattattcaacaacaactccaagacatgcaaaatgggctctttactgaaagcgaacttgctaacattaaaaaaggactacaatcagattatctttcggggatggacttgcaaagaaccgcacatcggcgtggattaaataattatctgttaaatcggcattggtcgacggaagaatggctaacccagattaatgcagtgtctaaaaaggatattgaacaattagctcagcaaattaaaattcgagctgaatatttcttgagtggagaataatttgaatgaataaaaaagtatatcaagcgttcaatgaatgcttattttcaaccgttctttccaacggtttaaaagttaatattttacccaaaactggatttaaaaaaacatacgctgttttaactactgattttggatcgatggatcgagaattcactttagatggtgaaaaaattcagattcccgctggcacggcacactttttagaacataaactttttgaaaaggccgaatacgatgcattcgaattgtttactaataacggagcagattccaacgcatttacaagctataccaagactagttatctattttcttcaacgactggattacaagagaatttagatattttgttagattttgttcaacagccatatttttcggataagtcagttgctaaagaacaaggaattattggacaggaaattcagatgtataatgacgattttgattggcaattatacatggggattttaaagaacctcttccccaatcaatccattagtgacgacattgccggaaccgtggaatcaattgctaaaattactccggagttgttgtacaaagtacataaagtattttaccgtcccaaaaatatgaatttatttgttactgggaacctagatccggatcagatccttcaatggattaaggataatcagcaacgaaaagagtttgcaaaagttaactttgaaattcctacttcagaatccgatgatgatgagattatcgaaaatcgtgcattattgactaaggttgaacgtcctaaagttatgttaggagttaaaaatgctaaagcattgcctcaacctggtattgaacgtctaagattcattattacgcttgatttggcgttatatttaatcttaagttcatcttctagattatatttagaattgtatgatgaagggcttttggacgacacttttggatacgatttaaatagtgaaagagaagccttgttcctaactttgggcggtgacaccaaccatcctactgaattgatacaagccttaaaagatattttgacaactggtttaatgaagtcggatgcgctcctcaaagatttcgagctagctaaaaaagaaatgtatggaagaagtattactaggatgaattctttggaagctattgctaattcatttgaaggtgaaaactatggaaatacgacaatttttgatgaagcaatgctttatcaagatatctctttagacgaagtaattaatactttcgatacctttatgaaaaatgttgttattagtacgtttaaaatggatagtgagcaggcgaagaaatgaaatttgcattaatttgtggagcaagtggcaatatcggaacagcgattagtaaagatttggctcaaaagggatggtcactttacttacattattatcaaaatgaggcaacaactaatcaattagccaatgagttacgggcagaatatcctcagcaagattttttaaccattcaagcgaatttcagaagcgaagacgctgctcaaaaaattagcaaaaatatttttgggttgaatgccgtggtttttgctcaaggaacgacaatctatcaattgtttgattgttttagtgcccaacagttggaaaatttgtggcaagaacagttaaaaacacccatgttagttattcaaaaggtaattaaaaaaataagcaacgctgaaaatggaagaattgtttttattggttcaatctatggaacagtaggcagttcaatggaggtaccttatagtgctattaagggggggattagtagttttgtaaatgcctactctaaagaagttgcttcactaggagttactgttaatgctgttgcaccaggggcagttgccactaagatgaacgatgaatttaatcaaacagaaattgaagcagttaatgaagaaataccggtgggacgtttcggtgatccatcagagatcagtcatatagttcaatcaattatggatgaacgggcctcttacctaactggtcaaacgatttatgttgatggtggatggaaaaaataatgatatacttatctttgatttagaaataagttgggcggtatacttatgagcactagaaaatacaaggaaattggtgagcgtctgcaagatgctcgtataaaaaaagggtggacgattgaagaagttcaatttaaactgcaaatttcaaaacgatatttaatggcgttagaagctggtgaaaatgatgatttaccaggtgattattatacacaatcactgattaagcaatatgccaatctacttgaaattgaccttggcagtcgcaacctaaaaagtgaaccgaatagtatcaaagaatggcgtcgtgcgcatgctgagatatcaagtcgtagtcaaaaagaagcacaacaacgaaaatcagttttgcaaggattaatccgacaacatccatggttgatgggaattgtattggtggttgttatttggcttttagtttggggagctttcaatgacatggctggacatactaaatctacgttcaaggtaccaaatcaggtcaaggtggttgatacaactaaagggacatctaccaagaaatatggtcagtcgaaggcaagttcttccaagaaggaaagttctagctcaaagaaatcggaggctacacttaaaaaaattaacaatagctccgataatttagaggtaacggtggctgcaggaagccagcatgctaacttaaagatgcagatgggtcaaagatcttggaatgtattgacggtaactcagcctaaagcagaaactacttggcaaggactgctagaagcaaaagctagcaaaacaattgaattgaaaaaaggttacacttatgcgcttaaaattggcgcctcaactgggtttacgggaacgattgccggaaaagaaatacctaaatcaactaccaattcggtggttcgaaatataacaattgaagtaaaataagagggagtatcaatgaatttacctaataaattaactatttttagaataattttaattccaatttttatcatacttacagtcatgccagaagttggtggaagtgtagtttggttgggaacaagtattgcagttaccaagatttggggggcacttgtttttgcaattgcatctattaccgattttttagatggacagattgctagacgtcaacatttagttaccaattttggtaaatttgctgatccaattgcagataaaatgttagtaatgactgcttttattgtcttagtagaaatgaagatggttccagcttggattgccgctatcattgtttgtcgtgagttagctattagtggattgcgcttaatcattgtggaaaatgatggtgaggtgctagcagctgaaatgcctggaaaaatcaaaacattctcgcaaatgttcgcgattattttcttgcttttgaataacattttctcaagtttcttacatttcggtctaggtacagtattattatatgtctgcttattctttactgtttattcaggaatcgattatttttataagaatcgggccattttttctgattcattctagtaatataaaggactatagcgaaatttatgattttgttatggacctttttttaatacaaaaaaataaaaacgagtaaaattacatatataagcattgaggaggaaaagaaatgaacgctgaaattatttcagttggtacagaaattttgttaggagaaatcgtcgatactaacgccgtttatctgagccagctttttgctaaattagggattgatgttttcaacaaaataactgttggagataacgaaaaaaacatcatggatgccttagaagtcgcttcgaagagaagtgatttagtggttacgatcggcggattaggtccaacagaggacgatatcactaagcaatccttggctaaatttgtcggaaaaaacttaaaacacgatcccgaggcgctacaacaaattgcagactattttaaaaaacaaaatcggccattgactaaaaataatgaacgtcaggctttattactggatggggctaaaccaattcataatcctaatggattagcccagggtattttttatcacacagagcaaaccgattatattgttttgcctggaccgccttcggaattcgaacctatggtggatgaaaaggtacttccgctactaagccagcaatatggtttggagaaaacaattcaatctaaaactctgcattttgttggaatcggtgaggcagatttagctgctcgagtagatgagattgttcgtaatcaaagcaatcctactatcgccctttactttaaaccaaccgatgtgacaattcgattgactgccaaagctaattctaagctagctgctgaggaaattttaaatcatactaaaaatcaactactagatcgagttggagaattcttttatgcagaaggtgacaaagtttctttcaccgattttgtcgttaatcaattgattaaacgcaatatttcattaacagcggcagaaagtttgacggggggagcttttgaaagtacggttgtagaaacttctggagcagcaaccatttttccgggaggatttgtaacgtatgctgatgaggtcaaaagtaagttgataggggttcaaccagcaacgattgaagaaaacacggttgtaagtcggcaagtagcggaagagatggctagaggggctcaaaagacgttagatacggatatagcggttagttttactggagtagctggaccaggggccttagaacatcaccaacccggaaacgtatggattggtttggctaaacgtaatgggtcaatagtcactaaagaatttaattttgttggtaaccgtgaaaagattcggcacctagccgtgatgaacggatttagaatgatatgggaaaatgttattaaataaaacattcgaacttttgttcgcttttttgttgatttttataaaataactatgtatcatactagtatagagaaaccctaggaggttattaattggcagacgaaagacaagaagctttaaataaagcacttaaaaaaattgaaaaaaactttggtaaaggatctattatgcgaatgggggatgcggttgatacgcaaatttcaacgattcccagtggttctttagcattagacgatgcactaggagttggcggttttcctaagggaagaatcgtcgaaatttatgggcctgaaagttctggtaagacaactgtagctttacatgcagttgctgaagtgcaaaaacgtgggggaactgctgcatatattgatgctgaaaacgcgatggatcctgcatatgcaactaatttgggcgttgatatcgattcactcttactttcacaaccagatactggtgaagaaggattagctattgccgatgctttggtatcaagtggtgctattgacctggtcgttattgattccgttgcagccttagttccacgtgctgaaattgatggagagatgggggatgctcatgttggcctccaagctcggatgatgtcacaagcacttcgtaaattatctggttcgattaacaaaactaagacgattgcgttattcattaaccaaatacgtgaaaaagtcggaattatgtttggtaatccagaaacaactcctggtggacgggctttaaaattctatgcaacaatccgtttagaagtacgccgtgcagaacaaattaaagatggtgccgacgttattggtaaccgtgttcgtattaaagtggtaaaaaacaaggttgctcctccattcaaaaaggctgaagtcgatattatgtatggtcatggaatttcgcaaactggtgaaatgattgatatggctgttgaaaaagatttggtcggtaagagtggttcatggtattcatacggagacgaacgcattggacagggtcgtgagaatgctaagaagtacattgatgaacatccagacgttcgtgcagaaattcttggtaaagttcgtgaagcgtatggtatggtagctgatcctacgagtgaagttaaaaaagaaagttccaaaaaatcttcaactgatgattcagatttagcttaaatactactaaaagattcaagaaacttttcttgaatcttttttgataggtttcaaactaaatgattcattgacactcttatacctaaatattaaaatgataataagtgtgaaaatcaaataacatcattcaagagatataactatggtcttgatgatttggaggcaaagatgataattttatatattatcctcgcaatcatcgctatagttgttggctattgtgcaggattctttatgcacaaacggctcattgaaaagcaaactgcaaatgccagtaattcggcagatgtaattgttgaaaatgcaagaaagcaagcagaaacggaacgtcgtgaaaagcttctagaagccaaggacgagagtcatcgctatcgggcgaaggtggaaaaagaattaaaagagcgacgggctgagcttcaaaagcaagaagatcgtttacttcagagagaagattctcttgatcgtaaggataattccttcgaaaagagagagaatagcctagaacgaaaagaacagaaacttgctctagaccaaaagcatatcgatgagcaacaacaaaaagcatcatcactcgttgaagaacgacaacaagaacttgagcgagtttccaatctaactcaagaagatgcaaagaacttaattatttccgaaacagaagctaagttggaaaaggaaagagcgttaataatcaaggaaggtcttgaagatgctgaagcagaagcagatcagactgccaggaaacttatcgctgaagctattcaacgcagtgcggctgatatggcatctgaaaccacaattacggtggtttcgttgcccaatgatgatatgaagggtagaattatcggacgtgaaggccgtaatattcgaaacttccaaaatgtcacgggagtagacttgatcattgatgacactcctgaagccgtggtattgagtagctttgacccaattcgtcgcgaaattgctcgaattgccttagacaaactgattcaagatggtcggattcatcctgctcgaattgaggaaatggttgaaaaagctaaaaaagaaatggatgacaatattcgtaagactggtgaacaagcggtctttgatttgggaattcattctatgaacccggaactaattaagttaattggacaattaaaatatcggacgagttatggtcaaaatgttttaaaccattcaattgaagttgctaatttagcaggtgttttagctgctgaattaggtgaagatgttactgtagcaaaacgcgcaggattattacacgatattggtaaagcagtacaacatgaaactgatacttcgcacgctcaacttggagttgagttggctaagaagtataaagaaagtgcaacggtaattaatgcaattgccgctcatcacgatggtgttgaagcacagcatgttatctccgtattggttgctgcagctaactcgatttcagcagcgcgaccaggggcacggagtgatacactacaaagttatattcatcgtttagaaaaactagaacagatttctaataattttgatggagtaaagaaaagttacgcaattcaagctggacgtgaagttcgcgttatcgttaaacctaataagattaacgatttgaaggcggttatgttgacccacaatattcgtaaggcgattgaaaaagagctcgaatatgctggaaaagttaaagtaacggttgtacgtgaagttcgagcagttgattatgctaagtaaaggagagttggactagcggtccgctctttttttgttatatgttagaatatccattgttaatgtattttttacgtatttaaaaatatgagagaaaaagctggaaggaaaaaagaatgccacaaaaaacaagtgatacgccaatgatgcgtcagtatatggaaattaaaaatcaataccccgatgctttcttattctatcgaattggtgatttttatgaattattttatgatgatgcggtcaaaggctcccagctattggaattaacgctaacagcgcgttctaaaaacgcagatgatccgatcccaatgtgtggagttcctcatcatgcagcacaaaattatattgatatccttgtcgaccaaggatacaaagtggcaatttgtgaacagatggaagatccacggactgctaaaggaatggttaaacgtgaagttatccaattggttactccaggtacaacaactgataagagtgctgaggatgccaaagaaaataactatttgaccgctgttaattttgattctaaaactaaaaaatatggctttgcgtatacagatctttcaactggtgaattaaaagttgcgattttagatgattttgatagcgtgattaatgaagcagtaggattacagaccaaagaaatagtaactgacgaaagccttgcagaaagttttgaagaacgttttaaagagttaaatattttagtgtctaagcaaagtaaagtggaaatatccgctgaattaagctatttaattcaagatttaacaagttcaacggaaatagaagttgttaagcaactacttacgtatgtgcaaactacgcagaaacgtaatttagctcatattcaaaaagcagtggcatatgaaccatctttctttttgagaatggaccatgcttccaagtataatttggaactaactcgtttaattcgtacaggaaaaaaacaaggaacattactgtggctgttggacgagactaaaacggcgatggggggacgtttactgaaacaatggttagatcgtcccttaatccgcaaaaaagaaattattagccgccaagatcgagttcaggttttagtagatcatttttttgagcgtagtaatttacaagaagagttaacaaaagtttacgatttggaacggctagctggtcgtgttgcattcggtagcgtgaatggacgagatttaatccaactcaaaacatcattacttcaaattcctaaggtacgtcatattttagaggaacttagtgagccggtctttgatgatgctttagaacatttggatccggttagtgatattgccgagctaatccaaaatgctattgatgaagatgcaccaatttctgttacagatggggatattattaaagatggttaccatgctaagttagatgagtaccgagatgcaatgcgtaatggtaaaaaatggattgcggatttacaggtacaagaaagagcgacaacgggaattaagacattgaagattggttataacaaagtttttggttactatatcgaggtaaccagagccaatttagctaatattcccgaaggacgttatgaaagaaaacagactttaacaaatgcagagcggttcattacgccagaattaaaggaaaaagaacggattattctggaagctgaacaaaaatctacggatttggaataccaattatttaaagaaattcgggaattaatcaaaaagcaaattgaaagattacaagatttagctaaacaagtggccgaattagatgtcatacagagctttgcggtggttagtgaaaaatatcagtttgttaaaccaactatgaccaaaaatcatgcaatcgaaattaaagatggccggcatcccgttgtcgaaaaagtgatgggacatcagagttacgttccaaataatattgatatggatgataatacagacattctcttaattacgggacctaatatgtcgggtaaaagtacctatatgcggcaacttgctttgaccgtaatcatggctcagatgggatgttttgtagccgctagtgaggcaactttgccaatttttgatcaaatatttactcgaattggtgctgcagatgacctaatttccggacagagtacttttatggttgaaatgcaagaagcaaaccgagctttgaaggatggaaccagtaatagtttagttctttttgatgaaattggtcgtggtacagccacttatgatggaatggctttagctcaatctatcattgaatttattcatcaaaatgtccatgctaaaacgcttttttcgactcactatcacgagttaactgagctcgatcaatcactagaacatctcaagaatgtccatgttggagcagtggaacaaaatggtaatcttgtctttcttcataaaatggaagacggccctgctgataaatcatacggaatccatgttgctaagctagcagggatgcctgataaacttttaaaacgtgcatccgtcattttagaaaaacttgaggctaaagatcaagctcattctgatggggttgagacaccagtctccaaagcaactccggttgaatcagagcaaacgccaaccatgattgaagaacaaatgactttgtttgaaacacctactaagccggttaaatcaagtcctaaagaagaagttgctaaccaactggaacagttaaatttaatggatatgactcccatggaagttatgaatcagttatataaatggcaaaagaaacttcgtaagtgaggtgattatttttggcagaaatacgtgaattaagtgaaattttagcggatcagattgcagcgggtgaagttgttgaacgtccagcttcagtggttaaagaattagttgaaaatgctatcgatgctggtagttctcgaattgatattttgcttgaagagtctgggttaaagatgattcgaattattgataatggtagtggaattgatgcaaatcaagttgagattgcttttaaacgacatgctacgagtaagatttcgtcgcgttcagacttatttaaggtggggactttgggttttcgaggggaagccctacctagtattgcttcaattgcagatgttgaaatgttgacagctacaactgatggaccgggtaaaaagattcattaccggggtggcaaattagaagatagcggtgatgctcaaagtcgccaaggtacggatattactgtacgggatctatttttcaatactccagcacgtttaaagtacttaaaatcgctccaaacggaattatctaaaattacggatattgtcaatcgcattgcactaagttacccagaagtagctatctcactacaaaataatgagcgtgagctaatgcgaacctcaggaaacggaaatattcaacaagttttagctaacatttatggtgccaaaaatgctcaaaaaatggtacatgttaaagaacaaaatattgactttacgattgatggttatattagtttaccagaattcactagggcaaatcgcagctatatcacggttctagttaatggacggtatatcaaaaatttccaaatcaataaggctattattgatggttatggttcaaaattaatggttggtcgttatccagtagcagttttgaatattaaaactgatccaattttagtagatgtaaatgtgcatccaactaaacaagaagtgcgcatcagtgaagaacagacactgttagatttaatttccaaagccgtttttaatgaacttgcagataaaaatttgattccggatgcagtagacaatttaaaaaagtcacgtgtaaaagtaagttcaagtgaacaacttgacttagctcggatggccatatcgggttcttttggtatggaacaggatcatgtaacgattccagatacagataacgacgaagttgaaaaagaagtaaatatctcggatcgatatgtggaacctgaaccaattgttattaatagtcgccaagatttaaaatctgataccattgccgaatttaaaaccaaatacgctaacgatgcagtagttaacaatgcggttaaagacggggatcagcctgaattaaaagagaaagacgccgtacaacgttttccaactttgacttacattggacaaatgcacggaacatatttgtttgccgaagctgaggatggtctctacattattgatcaacatgcagcgcaggaacgtattaattatgaatattatcgagttcaaattggagaggtcagtgatgatcagcaggacttactagtgccaatttacttagattattcaactacggatgctatccgaattaaagaaaagcaaacagtcttagagtcgtgtggattgtttttagaagaattcgggaaaaatacgtttatcgttagacatcatccaacgtggttcaaaaaagggcaagaggaagacaccgttaaagaaatggttgattatgttttaaatgatagctcaatgacggtagctaaatttagggaagcaaccgccatcatgatgagttgtaaacgagctattaaagccaaccatcatttagatgaaccacaagctaaacaattattaaaagacatcgctaaggctgaaaatccatttaattgtcctcatggtcgtccagtactagtacatttttcaacgacagacatggagaaaatgtttaaaagaattcaagatccacaccattctgacttgatggaagatgagatgtgatacaattaactgaatgcgaacaaacgttttgaaatgaggatttataaatgtatgaatatttagatggagtcgtcgttaacgttaatccagcttatattgttgttgatgtcaacggagttggatttttagttaacgtggctaatccatatagttttgaactagatgctaaacagaaagtttttgttcatcaagctgtttcagaaaatgatcaaactttatatggatttaaaaaagctgaagataaagaactttttcttaatttattaaaagttaaggggattggtccgaaaagtgcgttggctattttagcgaacgatgatcatacagggttgattaatgcgattaataatgatgatgtaagttatctcaaaaagttccctaagattggtcctaaggctgctcaacaaatcattctagatttgaagggcaaagtggcggttgaaaatgaagtaggaaccctttttgatttatcaactacttcaaaccaagctctagatgaagctctagaagctttgattgcattaggttattctgaaaaagaggttaagaaattaactaagaaattgagtgaacaaactgatcggacaactgatcagtatattagttcgggattaaaattattgatgaaaggataagacaagttgatggaagatgaacggattacttctgcggaagttcaaagtccagacgaagaaaatgaagagttgtcgttaaggcctcaaacattgcatcaatatattggtcaggatcagattaaacatgagcttgaagtatatattgccgcagccaaaaatcgcgaagaagcactagatcatgttcttttatatggcccccctggactagggaaaacgactttagcgatggttattgctaatgaaatgaacgttcagattcgaacgactagtggaccagccattgaaaaaccgggtgatttagtagctcttttgaatgagctacaacctggtgacgttttatttattgatgaaattcatcgattacctaaagtggtggaggaaatgctctattcagccatggaagatttctttgttgatattgttgtcggacaaggaccaactgcacatccaattcattttcctttaccacctttcactttgattggagcgactactagagcgggcttactctcagctccattacgagaccgctttggaattgttgaacatatgaattactataatgaagcggatttagctaacattgttcgacgctctgcgggtatttttaactcgcatattgacgatcaaggggcgtacgaaattgctagtcgctcacgaggaacaccgcgaatttcgaatcgtctgttaaaacgaatccgagattttgctgaagtagaaaatgatggacaaattgatcgccaattggttagtcagtccttgaaattacttcaagtagataatcgtggactagatcggactgataaaaaagttctaactactatgatcgagctctatggaggtggtccggtaggaatttccaccattgcagctaatatcggtgaagaaccagatactatttcagaaatgtatgaaccatacttgcttcaaattggattcctgaaaaggacgcctcgaggccggatggttacagaacgtgcctacgaacatctaggcttaattgatcaatatatgaataaatgaggaattgaaaatgacactaactactgaagattttaattatgacttaccacatgaattaattgcccaaactccaattaaagaacgcgatgaatctcgtttacttgtgttagaccacgaaacaggagcaatggaagataaacatttttacgatattatcgaccaattaaatcctggtgatgcagtcgttatgaataattcacgagtaatgccggctcgtatttacggaattaaggacaaaacgggtggtcactttgaagttctactattacacaatattgaaggcgaccgctgggaaacgctcgttaaacctgctaaacgagcaaaaactggaaccaaaattatatttggtgatggtgccttgacagcgacagtcaccaaagaattagaacatggtggacgtgagattgtctttgattatgatggaattttcatggaagttttggaaaagctaggagaaatgccgttacctccatacatcaaagaaaaattagatgatccagaacgttatcagaccgtttattctaaagaaccaggttcagcagcagctccaacggctggattacactggactaaagaactactagaaaaggttgaacaaaagggcattaaattagtttatttgacattgcatgttggactaggaactttccgacctgtggatgaagataatattgaagatcacaagatgcacagtgaattttatcaactttctgaagaatcagcggcagccttgaatgaagtgaagaagcagggtggaagaattgtggctacgggaacaacttcaattcggacgcttgaaacaattggctctaagtttaatggagaaattaaagctgatagtggttggacggatatttttattaaaccaggttatgaatggaaagtggttgacgcttttataactaatttccatttaccaaaatcaactttggtaatgctagtagcggcctttacgggaagagaaaatattttaaatgcttaccaacatgcgattgaagaaaaatatcgtttctttagctttggtgacgcaatgtttattaaataaagaactatgaatggagaaatacattggaacctgcaattaaataccgattaattaaaaccgataagcatacaggagcacgtctaggtgaaataatcaccccacatggtacttttccaacaccgatttttatgcccgttggaactcaagcaaccgtcaaagccatgtcacctgaagaactagaagacttaggagcagacattattttgtcgaatacctatcatttatgggtgcgaccaggtgaagatattgttaaagaaggtggtggtcttcaccaatttatgaactggaaaaagggaatcttaactgattcaggtggatttcaggtattttctttagcgaaattacgagatatcactgaagaaggggtgcactttaaaaacgagcttaacggagcaaacatgttcctttcaccggaaaaggctattcaaattgaaaatgatctgggtccagatatcatgatgagtttcgatgaatgcccgccttattttgagagttatgactatgttaaacattcggtcgaaagaactagccgttgggccgaacgtggtttgaaagctcatcgtaacccagaaacccaaggcctttttgggattattcaaggtgccggtttcgaagatttaagaagacaaagtgctaaagatttagttagtatggatttccctggatattcaatcggaggactttcagtaggagagtctaaagaagaaatgaatcgggtgttggatttcacaacgcaattgattcccgaaaataagccccgttatttaatgggagtaggttcgccagatgctttgattgatggtgttcttcgtggggtagatatgtttgattgtgtattaccaacccgcattgcccgaaatggtacctgtatgacgagtcatggtcgtttagtagttaaaaatgctaaatacgcgcgtgatttcacaccaattgatgataattgtcaatgctatacttgtcgcaactacactcgggcctatattcgccatctaattaagaccgacgaaacttttggtcttcgactaaccagtattcataatgtctatttcttagttcatttgatgaaagatgtgcgtcaagctattatggatgataatttacttgagtttagacaaaacttctttgaagaatacggatataataaggaaaatagtaagaatttctaagagtactggtttagaaaacgtatttttggtacagtatacttagacgactttagtgaggtgaaaaaatgttattagcagctgcaaatggtggtttcggaatgagttcaatcattttctttgttttaatcattggattgatgtacttcatgatgatcagaccacaacgtaaacaacaacaaaagcgccaagaaatgatgaatcaattgaacgttggagacaatgttgtaacaattggtcgtcttcatggggtggttgattcaattaatgaagaggaaaaaactgttactttagattgtgatggtatttacctagtttttgatcgtatggcaatcatgcgggtcgaaaagaaggctcttacgacaactgaaacaactgaaactaaagaagaagctcccgtaaaggaagccgaacctgaagaaacaactgaaaaagaagaataatttttcaaacttagaccgcgaattttaattcgtgggtcttttttttcttgtttgaagttttaaaatggtagataattaatctattgaaaagcgaaagcggggttataaaaatgaatcaaaaggctttatttattatttttggcggaacaggcgacttagcttatcgaaaattatatccggcgttatttaatttatacgaaaaaggatatttaaaagaggattttgctgtaattggtacagcacgccgtccgtggtctaacgatcactaccatgaagtagttatgagtgcaattgaagacgcaggccgtgattctggtcggactaacgatgacctacctcgcaaatttgcaagtcatttttactatcaatcacataatgttgatgatgtcgatcattatgtagctttacgtaaattagcagatgaattggatgaaaagtatgatcttcaaggaaatcgtattttttatttagcaatggcaccaagattctttggaacaattgctggccatctgaaagatcaagctttacttacaaagggaaatggttttaaccgattaattatcgaaaaacccttcggacgtgattatcccagcgctaaagaattgaacgattcaatttcgggttcctttaaagaagaacagatttttagaattgatcattatttaggtaaggaaccgatccagtcaattgctggattacggtttgggaacgcattgttcaactcgctttggaataaagaacatattgataacattcagattaccctatctgaatcacttggtgtcgaagaacgggctggatactatgaaacagctggggcaatgcgggatatggtccaaaatcatattatgcaaattgtttcgttacttacaatggaacggccagatgtttttgattcagaacatttacgtgacaagaaaattgaagctttggaaaatatccaaatgtataccaaagaagaagctaaaaaatatttcattcgtggccaatatggtgcagatgaggctaatacacaacttggataccgagatgaagaaggtacggataatcaatcaactgttgaaactttcgttgccggtaaattaattacacataatccatcattagatggtgtaccagtttatattcgtactgggaaacgattaactaaaaaatcaactcagattaacattgtatttaaaaatgatgatcaaaacatttttgctaaagacgcgtcagaaaaattaaagaccaatgttttgactatgcatattgaacctgatcaagggtttacactagaatttaatacaaagactggaaaccaaggttacaacctttccccagttcatttacgttatcgtaagacagccactgaaaaggctcaaattccagatgcttacgaaggtttgattcgcgatgctttaatgggaaataagactaattttgcacattggcatgaagttagccaagcatggaagattatggatgtagtccgcgaggcttgggatgaagaagaacccgcatttccaaactatgcaagtggtagtatgggacctgaagcagctatgcaacttctagctgatgatggacgtaaatgggtttttaatccacgcagctaataatggaaacagaagttttaactccgatcaacattgatgattctcgtaagataattcatgttgatatggacgccttttatgcttcaattgagatgcgagataaccccaagttcaaaaaccagcctttggtggtagctcatgatccgcgccttactggaggacatggggttgtcacaacggcaaactatattgcacggcaatttggtgtccattctgcgatgccggctatgaaagctttagaactttgtccagaggcgatttttaaagatccggacttcactaaatatcgtgcagtttcggaacaaattcatcaaatttttcacgagtataccgataagattgaacccgttgcctttgatgaggcctatttagatgtttcagaagataaaaaggggcttggtgacgctgtgttgattgctcatgaaattcagaaagttatctttaatgaaacccaattaacctgctctacgggaatttcatacaataaatttctggctaaaatggcttccaaatattccaagccagtaggtgtggcaatcatcgaaaaagatgacgttgctgagtttctaaagaatattccaatcgaacggtttagaggggttggcaaaaaaacagtgcctaaaatgcacgagctaggtgtttttcaaggtgcggatttaatcaaggtgtctgaaaatgatttaattcattactttggaaaatttgggtacaccttgtttcgttgggttcgcgggcaagatgatcgcccagtcgaatacttgcgtgaaagaaaatcaattggcaaagaagaaacgtatggaaagttgctcaccactgagatggaggttgaagagcgacttcgggtaattgctaagaatttacttcgcacagttttgaaaagacagaaacacggcaaaaccattgtattgaaactaagatatggtgattttgaaacgttaactaaacgaatcacattggacgaatttttccaaaatgatgttgaaacctattatttttatgctaaacagattttggatgaaattgctgatatttcgcgggggattcgcttattagggattacactaaccaacttaacggatcaaaattttcaagaagtttctttaccactgtttaagcactcagagtgattttgtgatatgcttaagagcgctaataataaagtattaaacttatattgataaaaatttaatgagtaggataaatgaggctgtaatggacacacttgaaaaaattttagaacaaatcaaaaaatataaccgaattattattcatcgtcatcaacgtcccgatcccgatgccattggatcacaagttggactcgccaaaattttacaagcatcttttccccataaacaaatcaaagtggttggaaaacaaatcgatggtttgagttggttgggtaacatggatgaaattgaaggtgatttcttcgatgatgcattggtaattgcgattgatacggccaattcaccaagaattgacgatcgtcgctttgagaacggggcgttcctaattaaaattgatcatcatccaaatgatgacccatttggcgatttgatgtgggtgaaagaagaagcatcaagcagttcagaattagtttttgatttctataatcgcttcaaggaccaattaacgctgacagcagacgcggctagagatctctatgcgggaatcgtgggagatactggacgctttatgtatgcagctactagtgcacatacgcatagtgtagtagctggtttaatggaaactggctttgacatggtagctgttaatcagacgttagacgaaataccagaatcagtagctcatttatcatcatacgtatatgacaaccttcaaattaaggctaatggggctgcccatattgttttaagtaaagaagctttggataagtttgatttgaaggacgctggaacagctggaattgtttcactaccaggtcatattacaacggttaaatgctgggcaatttttgttgaacaagatgatcactcttaccgtgttcgacttcgttcaaagggtccagtgatcaacgaacttgcaaagaaacacgacggcggtggtcatccattagctagtggtgcgaaggcagctaacattgaagaagttaaccaaattgtaagtgaattagatcaattggtttagacaaggagtatttaatgaacgaatttcagaagtttaatctaaaaccatttttaatgacggctttagatgagattaattttaagacacctacccctgtacaggataaagtgattccacttattgctgatggaaagagtgttgtcggacaatctcaaacggggagtggtaaaacccatgcttttcttttaccaatttttaacaatatcgatccggaattaaatgcaattcaagcagtaattacgacacctagtcgtgaattggcttatcaaatttatgaagatgctaagcaattagcctcagcttcagaagttaagattgaaattggcaattacgttggtggaactgataagaaacgtcaagttgaaaaattaggacatcatcaaccagctatcatcattggtacaccaggacgagttttggacttgttaaaggaacgggccttgaacttccgtcaagtgaagtatatggttattgacgaagctgatatgaccttagatatgggatttttaaacgcggtagatcaaattgctgctgcaatgccatctaagctgcaaattttggttttctcagctaccattccacaacggctaaatgtatttttgaagaagtatatggatcatccggtaattgaagagattcctaccgaaacaactattagccctaccatcaagaatatcttgatttcaactaagagctctggcaaaaataatttaatttataaattattgactatgggagagccctatctagctttagttttcaccaacactaaggaacgtgctgatgagttgaccgattatcttaaagctcagggactcgatgttgctaaaattcatggtggtatccaaccacgtgaacgtaaacgaattatgaaagatattcatcgtcttcgttatcaatacgttgtagcaactgatttggctgctcgtggaatcgatattgatggagtttcactagtaattaatgatgatattccgacagaccttgaattctttatccatcgagtgggtcgtactggtcgaaatggtatgtcaggaaccgcaattaccttatatatgccaaatgaagaagacaaagtagctgatgtcgaaaagatgggaattacattcttacctcaacagattcgaaacaacgaattagttgatacgtacgatcgtgatcgtcgtcagacgcgtcgtctgagtcaaaagaagcttgacccaaccatgattgggatggttaagaaaaagaagaaaaaggttaaaccaggttacaagcgtcgaattcgcaaagcaatttcagaaaaagaaattcgtgatcgtcgtatggaacaacatcaagcagttcgtgaagccaaaaaggctaagataaaacaatcacgaaataagcgaagataaattgacattttaaagttgattttctataattagctgtaatatttttaaaatcatttgagatatgtaggagctaaccccttagtgcaagagacattctggctggtgtgaagggtgaagggaagtttctatgctactcaagttaatgaatcgttttctcagcgttaatgagacttaagaggtatacgattaaacatcgttgcaagtaaagtggtaccgcgcagtcgcgtctttattattttacgtgcaatggtgttttttattttaggaggaaataatggaaagaaagtcaagtagtgaaattcgtcgaatgtatttagattttttcaagagtaaaggtcacatcattgaacccagtgcctcattagtaccgcaagatgatccaactttgttatggattaattctggtgttgctaccatgaaaaagtactttgatggaagtgtggttcctgaagtacctcgtctaacaagttcacaaaaaagtattcgaacaaatgatattgaaaatgtgggtcatacggctcgtcaccatactttgtttgaaatgttgggtaacttttcagtaggagattattttaaagaagaagctattcattgggcttgggcattgctaacatccaaagaatggtatggcatggacccagaaaaattgtatgttaccgtctatcctaaggatgaagaagctaaaaaaatatggttagaaacaccaattgatcctagccatattgtggaagtggaagacaatttctgggatatcggtgagggtcctagtggtcctgattcagaaattttctatgatcgcggtgaagcatttaataatcttgaagatgacgatccagaaaattatcctggtggagaaaatgaacgctggcttgaaatttggaatattgtattttcacaatttaaccataagccagatggaacttatgaaccacttccacataaaaatattgatacggggatgggattagaacgagttgtttctgttttccaagatgcccccactaactttgaaacagatttattcttaccaattatccatgaagttgaaaaacttagtggtaaaaagtatggagaaaataaagaaagtgatatctcatttaaggtaattgctgaccatgcacgggctattacgtttgctattggtgatggagctattccttctaatgagggacgtggatacgttattcgtcgcttattacgtcgtgcggttatgcatggtaaacaactgggggtaaatgaaaccttcctttacaagatggttccagttgtaggcgaaattatgaaggattactatccagaagtgttggctgatcaggattatattgccaaagttattaaatctgaagaagatcgttttagcgaaacacttacagacggactagaacttttaaatacaattattgatgaaactaagactaagggctccgacacaatttctggatttgatgtctttcgtttgttcgatacttatggtttcccactagaactagctaaagaatatgctagtgataaggggctcaaagttgacgaagcaggttttgaagatgaaatgcagaagcaaaaagaacgtgcccgttcggctcgatcaacagaaaaatcaatgggagttcaatctgatttattaacggatttaaagactgaaagtaaatatgttggttatgatactcttcgagttgataatgcaatccttgaaaatgtaattcaggatgggaaattaacagatattgtagaaccgggtgaagcccgcgtcttatttaatatcacacctttctatgctgaaatgggtggacaagttgcggatcaaggtgaaattagggatgccaatggcgaaattgtggcggaagtgattgatgttcaacatgcacctaatggtcaaaacttgcatactattaaagctttaaagaagatgcacagcggagcagcttatacattagaagttaaccgagctttccatttgaaagttgaaaagaaccatacagctactcatttattagaccaagcgctacgtgatattttgggcgatcatacacaacaagcaggttcgttagttgaaccaggttatttacgttttgattttacgcattttggacaagtaactaacgaagacttggatcgggtcgaaaaaattattaacgaaaaaatttatgatgaaattccagtaacaacggttgaaacggaccttgaaactggtaagaagatgggcgccattgccttgtttaatgataaatatggtaaaaaggtacgtgttgttggaattggcgattattcaaaagaattttgtggggggacccatgtcaagaatactaatgaaattggactctttaagatcgtttcagaatccggtgtgggagctggcgttcgccgaattgaagctgtaacttcacaggccgcacttgaattcttaaatactgaagaaaaccttttgaagcaaacagctggtcttttgaagagtgctcaattaaaagatgttcctactaagactgaacaacttcaatcaaatgttaaagcattgacacaaaaagttagccaattagaagctaagattgctaaatcccaagctgctaatatcggcgatgaaatggtagaaattaacggagtgcgtttaattgctgctgatgttcaagtttcaggaatggatcaattacgtcaaatggctgatgattggaaaaataaagatcaatccgatgtcctagtcttagctgctaagattggtgaaaaggctaatttaattgctgctgtcaaagatgattttgttaaaaaaggtcttaaagcaggagatttaatcaaagcaatcgcgcctaaagtaaacggtggcggtggtggacgtccgaacatggctcaggccggtggttctaatccggataatatcaaggctgctttgcaagccgctcgagaatggctagaaagtcaaaatggataatattacgagttagttacgagaagctccattcattgtgatttaggtgctaataaagtaaaattaggactagtatgtgaagaggggtgctaacagtgggaaaacttgatgaaacaatgttctttgactttggcgataataagcaaaacgatgtcagagaaactttaaaaacagtctacgatgctcttgaagagaagggatataaccctattgatcagatcgttggttatttaatttcaggtgatccggcatacattccacggttgaatgatgctcgtaatttgattcggaaacatcagcgcgatgagattatcgaagaactcgttcgatactatctatctgaacaaatcgctgatagcaaaaaggaagaaaattaatgagattaatgggaatggatgtcggttcaagaacagtcggaatttcagttagcgatcagttaggatggactgctcaaggtgtcgagattgttccaatcaatgaagatgaagaaatcttcgggattgaacgcgttaaagaattagtaaaagaatatgatgttgtaggtttcgtattaggcttgcctaaaaatatgaataacactgagggaccaagagttgaagcagcacgtaactatggtaagttattggaagaaacttttggattacccatcgattttcaagatgaacggctaacgactgtggaagctgagcgcatgttgattgagcaagcagatacttctcgttcaaagcgaaaaaaagtgattgataaattagcagctagcctgattttagaaaactacttaaacggacatggaaaattaatcgatagattaaagtgaggacaagcatatggataacgaagaacaaaaaattacacttgttgacgaacacggaaatgaagaattgtataacgtactatttacgtttgattcagaggactatggtcgttcatacgtcttactttacccatcagaagcagaagcagatgaagaggttgatattcaagcttatgcctttatgcctgatgaaaatcacgacttaggtgaaggggaattgattccaattgaatctgatgaagaatgggatatggtcgaagaagtcttgaatacattccttggtgatcaagaccaagattaatttcctagaaacggtccttgtttgacgatgagatattatctatcggcgagcgggccgtttttgatttgaaatgaaatgagattgatatgaataagaaaattttagatgttttagagtatgacaagattaaacaatctattcggcagtttatagctactgaaaatggaacaaaagagttacgtgagctagtaccaagtagcgatgaaactgaagtacgaaacgccttaaaacaaacactagatgcggttaatatttatcgtttaaagaatggtattccagttccgcggcttgaagatgtgacagaagcacttcaacgtttgaagattgatgctgctttaaacggtcaagaattagctcaaattggtagaatcctaagagctacacgaacggtaattaactttttcgatgatttagaaagtgaagaaattgaaatcgttgcactagatcaagtgattgagcaactagtaactattcctgaagttgaagaacgtttaagtaattcaattgaaggaaacggtcatttgttgaattccgcttcaagcgaactaagacggattcgtgcctccattactcgtatcgagagtgatgtgcgctcacgaatggaaaaattcacacgtggaaataatgttaagtatttaagtgaaccaatcgtgactatccgaaacgaacgctatgttattccagttcgtgttgaatatcgttctaaatttggtggagtagtccatgatcaaagttcatcaggacaaacattatacgttgaacctgaatcagtagtggatttgaataatgaattacgacaaaaccaagtagcagaagtccatgaagagcaacgcatcttacaagaacttagtgcattagtagctccttacacagatacattaaaagataatagtcgcattttgggccatttagatttactaaatgctaaggcccagtacgctcatcaactaaaagcaactgaaccgcaaatttcagcgtccgatgaaattaacctacgagaagcaaggcatcctttgattgaccaaaaaaaggtagtttccaacgatattagactaggtggagagtatgagacactcgtgattactggacctaataccggtggtaagaccatcaccttaaaaacggtgggactccttcaattaatggcacagtcgggaatgtttattccagctaatgagaatagtacggttcggatttttgaggaaatatttgctgatattggggatgagcaatccatcgaacaaaatttgagtacgttctcttcccatatggataatacaattcgaattttaggcaatttaaatgaacgttccttggcattatttgatgaattgggtgccggaacagatcctaaagaaggggctgcacttgcgattgctattttagataaagttcgcagcacgggggctgtttcaatgactaccacccattatccagaattaaagacttatggatatgaaagaatgggtaccattaatgctagtatggaatttgatgttgataccttgcagcctacctataagttattattgggaattcctggtcagagtaacgcttttgaaatttcaaaacgtttaggtttagatagtgatatcatcagtcaagcttgggggctagttgaccaagatagccaagatttgaacaatatgattaaagatttaacgactcgtcaaaaacgagctcaaaaaattaatcaacaagctgtggaattacttaaacgagccgaggagtaccaccaaaccttggtcaagggagtcgatagcctaaattcgcaacggagcaatttaattgagagtgctaaagaagatgcaaaccgaattgtgaatgatagtcaggccgaagcagaccgcattattaaacgtctacgtaagttagaacattccacaggaagttttaaggaaaatgatttaatcgacgctaaaagtaaaattaacgcccttcatcaggatactaaccttaaacgtaataaagttttacgacgcgctaaagaagctcaaaaattccatgaaaatgatgaagtagtggtcttaacttatggacaacgtggggaacttcttcggcaagttgataaaaaacattgggaagtccaaatgggaattatgaaaatgaaggttgccgttgatgaactggaaaaagttaaaccggataagacggtcaagcgacgagttcataactcagttcaaagaacggcttctgcgggagttaaaacaaccttagatttacgtggaaaacgttatgaagaagcactgactgaaaccgatcgctacattgatgctgctttgttagcaggttatgacgaggtaacgattgttcacggaaaaggaactggggcacttagaagtgggattaccaagtatcttaagaataatcgtcgaattaaagcttttgaatacgcacctgcgaatgctggtggaaatggtgccacgattgttcattttaaataatccttataaaatgtaagctaattatttcatttgctacgcaaagactggtatagttaacgtaacaaattgtgaaagagggtaattagaatggttgaagctattacagatgcaaattttgaagaaaaaacaaatactggcgtaacactaactgatttttgggctacatggtgtggaccttgtcggatgcaatcacctgtagttgaacaacttgctgatgaaatgggcgataaagtttcattttctaagatggatgttgatcaaaaccctgaaacagcaagaaactttggaattatgagtatcccaacactcttggtaaaaaaagacggagcagtcgttgattcaatcgtgggataccattctaaagaacaattagctaagattttagaccaatacatttaattaaattgaggctaagtagaaaccaatttatcaataattggtttctttttttatagagttaggtgggtaacatgctccctttttttactgaaatttagtattatgggtgtatgtataattttatttagtgggggaattaaaatggataatcggccaattggttttatggattcaggcgtcggtggtctgacagttgtcaaaacagctcaaaaactgttacctaatgaagaaattatctttattggagatgaagcaagaatgccgtatggtcctcgtcccacagcagaagtcgttgaattttcacgacagatggcgtcatttttaatgactaaaaatattaaggcgctagtgattgcatgtaatactgcgaccaacgcggcgttagcggttttacaagctgaattacccatcccagtaattggggtgattttacctggcgcaattgcagctaataggcaaactaaaaatcaaaaaattggggttattgctacactaggcacaattaaatctgaggcttacccaaaggctttagctgaaattaataccaaattacgtgcttatccggtagcatgccaagaatttgtagaaattgctgaaaaaaatgaacttcatacaacggcagctcaaaaagttatgaatgaaaaactagctgagtttaggcaagatcaaattgatactttgattttaggctgcactcattttccgcttttagaagaaggtatccaagcagccgttgggcctgatgttactttagtagatccaggagtggagaccgttcaccaattaattgaaattttaacaaaacaagcgcttcaacatgcagaaggtcctaaagcgcaggatcaatattattcaacgggtaatattaagaattttgaagaaatagcgcggacattcttaaatcaagatctaagagttgaagaagttaaaattgactaggagaaattagaatgaataatgaaattttgattgccacgaaaaatgatggaaaattaaaagaatttaaacaaatttttgaacaaaagggaattgttgtaaaatcactgaaagatattaatgatgacgttgaaatagttgaaaatggcttgtcgtttgaaaaaaatgcccgtttaaaagcagacggatacgctaaatcaattggtattccagtccttgccgatgattcaggtttggaaatcgatgctttgaatggacgcccaggaattttttcggcgcgttacgccggtgatcacaatgatgcagctaacaatgccaaagttcttagcgaattgggtggcattccagatgaaaaacgtacagcaacgtttcattcaaccgtagttgtgcgcaaaccagatggaagtgagttagtggcaaatggaaatctacgaggacgaattcttgctgttccgcgcggtgacaacggctttggttatgatcctttattttttgtggaagcaaagaataaaactttagctgaaatgacgcgtgaagagaaaaataaaattagccatcgtgcattagcaattgaagatttattagtaaactttgataaattctgggaataaataaaaaagtatgccatcaacattgaacccgtagtagagtgaattagatctaactttgggtgattataagatggcatacttttttactaattttgaattttaatttgttcttgggctaaagttcgtagacaacgatccaaaatcatagttttcatcggagtttgatagccggccttaaccttggcagagatttgaactcccagatatccgtaagtcttttcgactacaggagcgagaacaatgggagtagctttaattttatcggtgtcttgtttaatcgaagctagttggtcacgcaacaagtctttagcacggtcaatttcaaacggatcactgattcgtagaaagatggaaatagtttgacttccgcgagaatgatttgaaattgttgaaatggagcgattcggcaggtaatgtaaagtaccatcgagtgcttgaagttcaatggttcgtaaaccgattgaaacgacggttccatcgatggattgaatcgtaacactatcaccaacacgtagttggccttcaattaaaatagttaggccgttaataacatcggacacaatcccttgagtcccgagtccaatcgcaacacttaagattccagcaccggccaataaagtgcccactggtactcctaaatttgataaaatagtatagacgtaaaagaataggacggaatacttgaaaatatttttaaccactgcgtaaacggtttgtgaacgagcggattgtttttcaattggatcgtgatgttgaaaactattacggatgatatgtttaccaatccgattaataatccagaaaataatggtgattagaacgagttggaaaaaatgttccataaaagctacaccaattttttcccaatcaatatgagtaaagctggattttaatgatgggaagcctgctgcaatagtaagcatgtttttcataaataaaaatcgtcctttcagtaataatactattctaacagaattttgtagcgaataagtaggggttttaattgcacttaattatttgtaatgctattctgtagtcataaacgaacaggaggggatcatttgacaggaggcggaattgctgcaattattgctgcagtagcattgcttattttagttctattcattggattagtattagtgaatgcttctaaaacattatcagagattaatcgtagtatggcagtgatcacacgggatgttgatcttatatcacatgaagctgaaggtattatggcaaatgcgaacgaacttttagaagatgttaacggaaaagtcgctaccatcgatccattgttccaagcggttgctgacttgagtgaaagtacatcggatttaaaccaagcaactcgtcgtttagctggtcgggtaaaccatactggaaaaagcaagaataccggtaaagtagccacagccatgaatgttggtaaaggtgctatgaatatgtataagaaccataaagttaagaataaatagggggctatcagtatgtcaaagagtagttttttactaggtgtaatcttgggtggagcagctgctactgcagcagcaattaagttaacagatacaacacctcaacaacttaaggaagctgctattgagaaatttgatgatttcatggaatctaatgactttgatacagctacgcttaaagatcgagcagtttcatctgtagatgatttaaaacaacgaggaatggaattagctaatcgtgctaacaataaatttaatcctgatttagaagagatggatgaagatttagttattgataacatggcagaagcgactccatatgaaaaacccactgaggtatttatgcctcacaaaatccaagaataaataaaaaaagatggaaactagtagctattgctagttttcatcttttttattttgaaatggtgatgattttactcggtaagcatatttattgatttttacttataaaagataaataatcagatatgaaaaacgaaaacgttttcaaaaagctgaggaggaaattattcatggcagaaaaaattcaagcaggaatagcaatgttaaaagtaattgaatcatggggtgtagaccatatttacggttaccctgggggatcaattaattcaactatggattctttgcaaaaagaacaagacaatattaaatacatccaagttcgacatgaacaagtcggggcacttgcagcagcagctgacgccaaattgactggtaaaattggggtagcttttgggtcagcaggacccggcgcggtcaacctacttaatggattgtatgatgcaaaggaagaccatgttcctgttttggcaattgtaggacaagtcccacatacccgaatgaattatgattacttccaagaattcaatgaatctcctatgttcgatgacgttgcggtttacaatcgaattgtgatgaccccagaaagtttgccatatgtaattgataaagcgattcgtatggcatataaagaaaagggagtagcggtagttattattccgaatgactttggctacgtagaaatcccaactggtaattattctactgaaaaaacacgtaatcaacctgagattaaacctcaacctgattctgaattagtgcaagatgcttgggatatgattaaaaatgctaaatatccagttattcatttaggacaaggtgctcgcggagccaccaaagaagttgaggcattatctgaaaaacttcaaattccaatcgtaattactgggttagctaagggcgtaatccctgatgaatatgaggggaatatggggccatttaaccgagcggcttctaaggtttctaatgaattaattaagaaaacggaccttttaatttcaattggtgctaacttcccatttgcagcaattgtatatggagatcgaccatttaagtatattcaagttgataatgatcaagctatttttgggcgccatcattcacttgatttaggaatttgggcagatgctaaattattcgttgaaaaattggatgaaattagcgaagccgttcaaccgcgtccattctacaaagcagctgtggctgcccaaaaagactggcgtaaatacctaaagggcttgatgcatcggacagatggacctctagaatacgaacaagtttatcaacaaattaaccgaattgcagatgacgacgccgtattttcaatggatgttggggataatattattaatagtttccgtttccttgatatgaatcctaaacaaaaaatcttaacttcagctttgtttgcaactatgggttgtggaattcctggagcaatggctagcaagttaagctatccagatcgtcaagtattcaatattgctggagatggagcgttctcaatggtaatgcaggatatgattaccgaaaaacgttataacttaccaatcattaacatcgttacatctaaccgccatctaagttttattaagtctgaacaagatgacgttcctcaagatgaattcggggtagatttaactgatgctgactatgctaaaattgctgaaggaatgggtgttaaaggaattcgagtcgatgaaattagtcagctcgaaaaagcctttgatgatgctgttacagaagtaaaagctggacgtccggtgttaattgatgccaatatcacggataaacgaggaattccagttgaacttgatttggaacaggacgatacattgtatacacctgaatttcttaaagaatgggatgcagaagaattgaagccatttgatgaatatttagctcaatattctgccgaataattaggctatataaaaagcgcttcggcttagaaccgaagtgctttttgatagaaatattatagatatctaagttcttttgaagtatgggtaaatggtaggcaaccatccttagtgatgtgaacacagtcttcaatgcgaacaccagcaacgccggggatatagataccaggttcgattgagaaacacataccttcttggaggattaaatcgtttccttccatgatggatgggaattcgtgttctcccatacccattccatgtcctaggcgatgaatgaagtattcaccataaccggccttatcgatgatgtcacgtgcgactttatctaaactagcagcagtaattccaggtttggcgtaagcttgggcagttaattgagcttctagacaaactttgtaaatatctttttgtttgtcatttaaagttcctaaagcgaccgttctagaagcatcactaatataaccatcatggatggtacctaagtcgaaaagtactaattcattattttgaatttggttcatgccagttgcaccatggggttcagcagcatgagcgcccacttgaataagagtatcaaaactcatttccattacaccacgcttttttaaagcatattcaagttcagcagcaacatcagcttcagttttaccagcggcaactgcattgaaaccaacttcaaaggcgtaatcagcctctgcaccagcagcatttaatttttcgatttcgtcggcagttttaatcatacgaaatttttcaaaaactggagttaagttttgttcaaatttagcatttggaaattcagaacgaagtacttcataacgatcaaatgtaagattattattttcaattccccagtgaatagggttagcattgcgttcacgaatatatttagcaattaattgaaagggcttctcgtgatctaaataaccataaacggggtgattccatccagtatctttaattgcttcaacttctagtgcaggagcaaataagaatggttcatgatcaggaaaaacaaataaagctaaaacgcgttcgatagggtcgctaccaaaaccagttaagtatttaatactttcaaaattactaatatatgcaacgtctaacttatgatctgaaacccatgcttggactttatctaattgtgacatttaatctcttctttcttatattcggatagttagattatagcacatagggaaataggtaataaaataaaaaaaggttgcaagtatgctgaaaatttgataacgtattcatggcaatgaaaacagaatgaaaacaaataatatcaatggaagaggtaatataatatggcaaaacaaaccatcacaatttacgatgttgctcgagaagcgggcgtttcaatggccacagtatcacgcgttgttaatggaaatcctaatgttaaacctgttacaagaaaaaaggttaacgaagtaatcgaacgtttggattaccatcccaatgcagtagctcgtggtcttgctagcaagagatcaactactattggagtaattctaccagatattactcaaatgttttttgcatcgttagcacgaggaattgatgatattgcttcaatgtacaaatacaatatcattttagaaaattctgacgaagatgttgataaaaaggttgaagtgcttgaaaacttacaagctaagcaagtagacggtatcatttatatggggaatgccgttgacgatcgtttacgagaagcgtttaaagcagctcgtacaccagtcgtttttgctggttccgtagatgataagaacactttgccttctgtaagtatcgataataaggctgcagtatacgaagcagtcaataaactaattgataataaaaataagaagattgcttttatctcaggtccgctttctgaacccgttaatggtaaatttagattagaaggttatcgtcttgctttaagtgaagctaaagttgattatgacgaaaatctagtttttgaaacaagtaatacttacgaagatggagttaagttagcatccgaaattgcttctacaacgggcgttacggccgcttttgttgctaatgatagtttagcggtgggcttacttaacggccttcaagatctcggcgttaaagttccggaagatttcgaaattatttcaagtaataatactagcttgactaagatggttcgtccacaaattagttcaattggtcacccaatgtacgatactggggcggttgcaatgcgtcttttaactaaattaatgaataaagaagaagtcgaagaacgtaatattactcttccatttgatatggtcttcagacaatctactaaataaaagaaaaaatccacttctacattaggtagaagtggattttttgtttaattatatgttataggaaaagtcctttatacaaagcaacggcacaaataccagctaagattggggcaacaacgggaactgatgcgtaaccccattgagatgatcctttatgtttgattgggagcattgcgtgaactaaacggggacctaagtcacgagcaggattcaaagctggaccagtagcaccaccaagtgaagcaaccaaagtaccaactagaaaaccaagtgcaataaatactgatcctttattagcctcgaaataaggagcatgagtaaaggctgtagccccaaagaagaggacgaatgaaccaataaattcgttagcaaaaccattccaagagctatgactagcatcaattgtactaaacgtacctaaaattgattcagtattagtagttaaatcataatgaggcttgtaagcaaaataaactactaattgtccaaaaatagcacctaacatttgggcaataatgaaaggaaggacctgagaccatgagaacattcctgaaactgctaaaccaatggtgaaagcaggattaatttgagctccagaaatagttccaaacattaatgcagggaccattacaccacatccgtacccaactgcgatgactaaccaatcactaccgttaccttttgtacctttaagctcaacgttagcaaccgaaccattacctaaaagaactaaaattgctgtaccaagaaattcagctgctaacttggcaaaaaaactatattccatattatgtaaaactccttaaaaataaaatttacgtaaaacacgctgtttatgagtatatcttatttgaaaggcaatatgcaaagctttcttaacatttctcaaaaaataagaaaattggatgaaaacaagtatagcaagtcttaagatatcttgaagagtaatgagagattacggaatagtggtaaaatgaagatatattatgagcttaatggaggagtggtcccaatcgaagaaacaaggatgacaagagaaacgcttcaagaaaaaaatccgacaattgacagaaaaccaaggctgttttggataagagtattgatgattatttgtgggttattactatttttaactttctcagctaaacaaaccgtctttaatgtaaactatgttcaaagtcaggtggttaaatcgaatgcggctagtacaattaatcagcaagttaatacacaattgcaacaagcagggattcaacagactaatttgatccctgataatgtaattaatgatgaattgaagtcaatgattggtgaattttatgctggtgaggaagtcaagttagatcaatcaatcattacggaagaagttaatgcaaatattggcacgtccggaatgatacaacaagggatagtttcgattattgttaatcaagttgctaatatttttaatagccagttggatacgcaaaaactaacgcattatgcgggacaggtagctaaattacaaaagttgaatcaaatcatgatggcgattagtgcagtaggactgctgatactaacattctttgctttcattaaacgacgcggtctcaatttattaggttccatgatggtgacggttggggcatttgctactgtgattagtgccatcgcctatgtatcaaatgttcttaatgatttgccaatccaatatgctgtaattaaagggattgttgagcaagcaggacaagatattttattacgtgagttaactatggcacttggtattttaatattaggaatcattttattggtgttgtcttttggggctaatcaggtcaataaaaaaagaagtaaaaatcgttaatgatttttacttctttttttattttagtctgaccacatatcatttaagacgatggtttgttcacgatcagggccgattgaaaaggtgctaactggaactccagtaatttcttcaatctttttaagataatttttagcattagctggtaattcttcgtaagtagtcatttgagtaagatcttcatcccaacctggaagagtttcataaattggagttgaatttttaagttctttttctgaagcaggataatacttaatcacgccgtgatcagtttgataaccagtacagattttaagttctttaaatcctgaaaggacatccaaacagttaacaactaaatcagttagcccattaacttctgaaacgtatttcattaatacgccatcaaaccatccaattcgacgaggtcgtttagtaacggtaccatattcatgagcaatttcacggattcgatcaccgacttcgttgatttgttcagttgggaatgggccttcaccaacgcgagaaacgtaagatttacatacaccaatgacgtgtttaatcttagttacaccaattcctgcacccgtagcagctccaccggcagttggattagaggaagtaacaaaaggataagtaccatggtcaatatcaagcatagtaccttgagctccttcaaataagacgcgtttattatcatttaagttagtgtgaattaggtagcttgtatcagtaatatagtccttaagaatttctccatattcaatgtactgagctgtcaattcctttaagcttggaagttgattccaaagatcttcgtctagaatgcgtttcttttgttcaagattaaaagcaattttttcttcaagagtttcgttgtctaatagatcaatagctcggataccaatacgttgcatcttgtccatgtatgctgggccgatacctttattagttgttccaattttttcgccatttttagaacgatcacgttcttgttgttgatcttgtaagatgtgatatgggaaaacgatatgagcacgatcagaaatttttaaatgatcagtgttaacacctactccatttaattctttaatttcatcaagtagggtagcaggattaatcactgttccattaccaatgatacaaattgaattaggagcaagaattccggaagggattaaacgaagagctaatttttggtcgttaaccacaagtgagtgaccagcattatctccacctgaataacgcactgtaacatcagcactttgtccaagaaaatcaataatctttccttttccttcatcgccccattggcttcctattactactgtagctgtcatatttattcctccatttttatcaatacacaactctaaagatgataacacagtttaccaaaaaaataaaagtgataaaccgaattatacaaaaggtaattcttttaatggttcgtgtttattaatgctgaagattttggtaaaatggagaggtaaatatttttaattcaaaggagtaatcaaatgattgatcgttatgcaagacccgaaatgcaaaaaatttggaaccgccagtcccaatttcaaagttggcttgacgttgaaatagccgttgttaaagcttggaataaggatggaaaggttcctgatcaagatctcgaactaatcgaaaagaaagctaagtttgatttagatcgaattgatgagcttgaaagtcaaacgcatcacgatgtaattgcctttactaggtccgtttccgaatctttaggcgaagagcgaaaatggattcattacggattaaccagtacagacgttgtcgatacagcgcagtcgcttcgactcaaagctgctaatgaaattatttcggcagatttagaaacactaaaaacaaccttgaaagaactatcaatcaaatataaagatttaattgccgttggacggactcatggaattcatgccgaaccaactacaattggattaaaatttttacgctggtattcagaaattaatcgtaatattgaacgttttaatcatgcccgtaaaaacatcgaagttggcaagattagtggggcagtggggacttttgctaacattactcctcaaattgaagaatgggtttgccaaatgcttggaattgggcatcaagaaatttcgactcaaatcctcccacgtgatttacacgcagaatatttgagtgttttggccttaatcgcctcccaaattgaagaaattgcaactgaaattagacatttacagcgtacagaagtcaatgaaatgcgagaaggatttgctaaaggacaaaaaggttcatcagcgatgcctcataaacgtaatcctattggttctgaaaatgtttcaggactaagtcgagttgttcgtggagaaatgatgacagcgtttgaaaatatgaatttatggcatgaacgagacatttctcattcgtctgctgaacgtgtaattttaccagattcaacagctttagttgactacattcttacacgaatgaatcggattttaaataacttggtagttaatgaagatgaagttcaaaaagaccttgaaatgactcatggattgattttttctcaacaagttatgttgaaattgattgataaaggttggacccgcgaggaagcctacgatacagttcagccaattgctatgatggtatggaatactgggcaacattttatggatttactacttgaaaatgataaaattaagtcaattcttgatgatgaagaaattcgagctatttttaactatcaataccatcttaaaaacgttgatgcaatctaccaacggtgtggtatcgaagcataatttagattaaaagggatgaggaattttgatgaaaaaatcaaatgaagcgttacttgtaattgattatacgaatgattttgtggcatcgaatggtgcgttaactacaggagtagttggacaaaagattgaatcagagattatcaagttggcgaaccaagagctacgtgaagacggttgggtgtttttgccaactgatgtacatgtagaaggcgatccatatcatccagaaactaagttatttcctgcacacaatctcaaaggaacatggggacgtgatttttacgggcagttgcaggattggtacgatttaaataaagctaatcaacgagtgaaaatccttgataaaactcgttataatgcttttaccggaacggacctagatatgcaactaagagctcgtaaaattgatacagtacggctagtgggggtatgtacggatatttgtatccttcatactgccgttgatgcatataatttaggctatcgaattattattaatgaaaaaggtgtggcaacctttacagaacatggtcaagaatgggcactagaacattttaagaatgcactaggtgctcaggtcgaataggattaatataaatgggaaccgctgagaaaattattttttcaggggttcctttttatgtggtagtcaaaaatcagcctaatttatgatagaatgaagtattaagtcgaattaaagcggagttaataatgaactttacgttaaaaataattagtagtattttttcaatcccacctaactagtctgggaattgaaaaatcaaaaattatagaaattattaaataaaaggggattttaaatatggtagaagcaattaatttaaaagcaggcatgacgttcattaaggatggtaaattgattaaggttgtagaaactaaccatcataaacctggtaaaggtaacacagtgatgcaaatgaagttatatgatgtacgagcaggttcaactgttcaaacaactatgcgtccaactgaaaaagttgaacaagctattcttgatactaaagaagctcaatatctttatcgtcaagatgatatggctgttttcatggatactgaaacatacgaacaatatgaattaccagtatcaagtattgaaagtgaattaaaatatcttttggaaaatacaatggttaaaattagtttttatggtaatgaagtaatcggggttgatttaccaacaacggttgaattaaaagttgttgaaaccgcaccatcaattaaaggagctacagttactggttcaggtaaaccagctacaatggaaactggattagtagttaatgttccagactttatccaagaaggcgaagttctagtaattaatactgaaaaaggaacttacacaaaacgcgcataattgtctaaaaggattgatagtaggaatactattaatcctttttttgtcggcttttttgatagatgaatgattctcttggagcctaactgtaaaaaggaataatagatattttacccgatttagaaataagcatcgcatatcatcagcgggtatgttaggataaatttgtagttagcaaaaactacgtttaagggcagttataaaatgattttacaatcaagaaaacgagcactaagtggcgaagctagaatataaaatacttattgaccccccaaatcaatgagtctaactcaaaagctagcaatagctcaataatattacattgtcccaaaacttaatatattctactatcttttaatcgggatagtcgccccctcgttaataagaaacgtttctatttttaagaagcgttttttatttttttcttgtcaaaaggaacatacgttcgtataattgagagtggaggcagatttaatgaattatgataaagaacccaagggtgtttttttaatgattgataataaatctttttatgccagcgttgaagcagttatgcgcgggctaaatccattaaaagttgttatggtagtaatttctgagcaggaaaataccaatggtggactaattttagccacatcaccgatggccaaaaaactttttggattgaaagctaacgtctcgcgacaaagggatttaccgtgtgatccaagaattataatggtcccaccacgaatgaatttatatattaaacgtaatcttcaaattaacgaaatatttaaacagtatgtggcagaagaagatttatatccatattccattgatgaatcaattttagatattactaaaacctggaaactttttggagaaactcctgaagaagttgctaaaaaaattcaacataaagtacgtaggcagttaggcttatacacaacaatcggtgtcggtgaaaatccattgcaagctaaactagcattggataatttcgctaaaaaatccaatgatttgattggcacaattacatacaatacagtagcccaaaaagtatggatgattcctaagttgacagatgtgtggggaattggaagacggacgaccgagcgtttgcaaaaactgggtattaacaatatgaatgagttagcacatagtaatccatattttttaaaacaagagtttggaataattggaactcaattgtttgcaacagcgtggggcattgatcgaacgattctaagtgaaagggtaaaacctaaagaaaatagtgtgggtaattctcaagtgttacctagaaattatcagcagcaatgtgaaattgaaactgtaattaaagagattagtgagcaggtagctgcacggttacgacatcggtgtcaacaatgtggtgagctaacgttaagtattggatttagttaccagtctacgataaatagtgggtttagccagtcattgaaggttattccgactaatagtaatgtagaaatttttaaatatgctaaggagattttccaaaagtactggaaagggcaacctgttcgtaatatagctatctttactgctaaattgagctatcagattggtgaacaattgaatctattcgaaccgtttccgaggatttccgaacatcaaactgatcaactggttgaccagattagagcggaatatggctttaccgctttagtttacgcacgtagcttaactaaaggtggtactgcaatccagcgggccagcctagtaggtggacataatggagggaatgcttatgaataagcaacaagaattaactttaattaatcagcgaattgaaacactgtttaatgtttcaaaatttaacactcaattttggattgtaattgttaatgatatctatgatcattcttataatattttttttagtgaacaacgacgagggcaaagggaacgttctattccaattcatacgcttgaaaaatatacattaatagatctagaagagattgtacgcgggcttcagcaacgctggaagtttactataaaatttattcaatttgaaaatcaactttggcctactagtcaaaaagttattcaaaaaaagaggcgtagagatgaataacaaaaataatcaatatgatcctcaagtagttcaaaacttttttgataatgtgtatattgatcgaggaatgataaagtggcaaggcttttttctttcagatcatactgtagcaattaaacgtaagagaaatgataacaaaatattttatgagcaaaaaattccacccagaatgaaacaaggtgaaatcagattaaaagttgctcgggcatatgaagagcaactattagttgaaattcaattaaatgaatgtaaccgtgatttactctttgaaaatgcaataaaatcgcgtattaaaggatttaatgaagattctgtatatttaggtgatggaaagtttgttagcatttcgatgatgcgttcgattaggttagcgaacaatggaaaagggtaaggtgaggattgaatgtaagcattgacaaaccccactataatacgtaatatattaaacgtctatgaacagataaaaaattgaaatgaaagaaggagttcgggtatgtcaggacattcaaagtggcataatattcaaggtcgtaaaaacgcccaagatgcaaagcgtggtaaaattttccaacgaatctctcgtgagatttatgttgcagttaaagctgggggtccggacccttcttctaaccctcaattacgtttaatgatggataaggcacgcgcagcaaacatgccaaaagacaacatcaaacgtgccgttgataagggtagtggcgcaggtggtgctaactacgaagaaattacttatgaaggatatggaccagctggtacagctattatcgtgtcagctcttacagataacaagaatcgtactgcagctgctgttcgttcagcattcactcaccatggtggttcactaggggcttcaggttcagtttcttacatgtttgatcgtaagggttacattgttattagtcgtgaagaccttgataaaaatgaagatgatatgatggaagatgcaattgatgcaggtgcagacgatgtacaaacatcagaagaggtatttgaaatctatactgatcctaaggaatttgctgctgttcgtgatgctcttgaagcaaagggatacacattggctaatgctgaattaaccatgattcctgaaaacgaaacaatggttccagaagataaagttaaacaatatacaggtttaattgatgaacttgaagataatgatgatgtttcagaagtttatgaagcagctacattacctgaagacgctgaataataattattaaaggcaaggacaattaagttcttgctttttttatttaatcaagaatttaaaaatttagtatgataaaatttacttatataacatataactgaggtggcgtaatgagtaataaagtggtcgttcttggcagtctaaatgtggatacaattttacaagttggacggtttccagaaccaggggaaacattggctttaaaagataagcaaatggccggtggtggaaaaggagccaatcaagcaattgcagcggctcgttcaggtgcagaaactagttttattggtaaagtcggaaccgatgcgaatgggcaatttatgcttaaacaattacttgatagcggggtttcaacggaatatgtggcaacctccaaagtagcggatacaggtcaagcttttgtaatgctcgaaaataccggtgaaaatcgaattttaatttatggaggctctaatgctgagttaaatgaggatgatgtcaataaggcagctgaaaaaattcaacaagctgattttatcgttgctcaattggaaactccacttgaaacaactaaatatgccttcgaaattgctaaacaagctggaatcaaaacaattttaaatcctgctcctgcagttaaaaatttacctaaggaattaattcaattgacggatgttatcacacccaatgaaactgaagctgaaattttaacaggcgttacggttgtggacgatgcttcaatgaaagaagcagcacaaagattacataaaatgggagtccagacggtcattattaccctaggtagtaaaggggtttattatgacgatggcgatgtgagcggcattgctccggcgtttaaagtgcatgcgattgatacaacagcagctggagatacgttcctaggatcttttagttcggaattgaagccagatttaagtaacttaaaagaagccattatgtatggcaataaagcttcctcgctggctgttcagaagatgggtgcccaaccatcaattccaacacgcaaagaagttctaaaataaatagtcataacaaaaaaacatgaaccattcaggttcatgtttttttgttgtctaaatttaactaattaaaaaataaatgttctgtttttgagtatatatacggtgaggaggacgtgagatgaatataaccagtaagctaaatcaaatcatccaagagtgtcttgtcaatcgggatagtgatttattcattatgccgcgatttgataaatatcaattattatatcgagatgcgggagggtaccgaaagtctacccagattgatagagatgaagcagaacaaattatgatgtatatcaaatatcgggctgatatggggatcagtgagcgacgaaggccacaaagtggggcgatgacttggttaaaccgccagggagaattagttaatttacgaatatctacggtgggcgattttttggatcgaccttcgatggtaattcgttttatatatgtactaaagcaagatgaacatattttagatagcgaaagtatggaaaaaatccaactagcaactaagcttcggggattaatggttttttcaggtccaatgggctccggaaaaacaacgttgatttacgaagtagcccgtaaattaagtgaaaccaagatggtaatgtcaattgaagatccggtagaaattcgtgaacataattttttgcaactgcaagttaatgaaaaatcggggatgtcttatcaagaattactgaaaaatggtttaaggaatcgaccagatgtttttattattggcgaaatccgagatggtaaaactgcagaaattgcgattcaagctgcattaagtggtcatttagttttaaccaccgttcactctaaaagtacccgaggggtatggaatcgaattgttgaattaggtgtacgagaagagcacttaaaagaagccttaacggcagttatctatcaaagaatgatttctgctaaggttggtgatttaaaaattatggcagaaattaaatcattccatccggccctgaaaggaacaaagaagaagtggacagaacgactagaggagtggaaggaaagtggccaaattactaaagaagtatttgaagatttccaatacggatagaatccaattaaatgatcaagcgtttattttttcaactatggttgatttaatgaaaatgggtgtttcgattcgcaagagtgtggaatttgttcgaattatgcgtccagcgattgctaaacccatggaaaaggtgattaaccagttgcagcgtggtaaatcattttcaacagcttttggtccgtatgtaagtactaatatctactatcaattagaaattgccgatcaacacggcggattagagcaaaccttagaaaccatcgctaaaatttttactagtcaaagtcagcaacgtaagaagttaaagtcgttaattcaatatcccgtttttttaatggcattcttgggaataatgatgctagggatgcgaatttatattatgcctgaactggataattggaatacggggacagcaagtattcaaagtcaagtgattaaattggtaataattggtatgttatttggaattgtagtaggaatattatatttatggctaaaatttaaaaagaaaagtatggctaatcaagtcgctttactatgtagaataccaatctttggccagttgtatcaaacatattgtcattactacttaaccgcaaatttatcattttttattagtagcggtatgtcgatgggaagtgtttgtaagtatttaacccttttagattcccagtctttacttcatcaaattggccgacgggtcgaaaaaagtatggctagtggtcaagatattagttcggtaataaagaaatcggtttatttgccaattgagctagacttattgctgcgtaaagggagtaaaaaagaaacattatcaaaagaagtgcatgcattatcaatgattaaatacaaaactttgattcaaaaaattgaatgaatgattttaattgtccagccaatcttgtttggcataatcggaattgtcattgttttgatgtacatgagtcttttaatgccaatgtataattcaatgaaggaagtgtcaaaatgaaagcgaaaataaaaaaaggttttactttgattgaaatgaccatcgtcttatttattatctcattattaattttaattattctacccaatgtcactagtcaaaagaaaaatgctagacatattcaaggagatgcgatgacacaagtggttcaaactcaagtagatttgtacgaaaatgaatacaacgagttgcctaagtccttagatgaattacaggacaaaggttacttatctgataaacaagttcaataggctaatcgaaatggcattaagattaatgatggacatgcagtcggaagctaaagttagctgttatttgaaaaaagcattttcactattagagacgatgatcgttctcttaataacaagtggaacgatcttaatgggttatgggggttttaaaggagctcagagcgccaataatgaaaaaatattttttagaagatttgaaatgagttggaaggatacacaacgtctaacagcttatgacggatacaaagctacggtaacttttcagaagaatttccatgaggtaatttttttatgttatcggaatggtcataaaatttcaaaacatctggagttacctaaaggattggagccggtttacgatcgaaccattaacattggtaaaaatggaacggtcacaccaatcaatgtgatgctagaatccaatggaaaaattaaatataagttatcagcacaaatgggttggggagtttatgaaatcaccgaaaaataaacaaggaacactgttatacgaaggaatcgttagtttatttttattaggaggctttggcacagttacattgaattcatggcatatgtggaacgataaaataaatagagaacagattgaactaagttatgagcggacaatattaaatgaaatcagacaaaagttataaaaagagtggttttacattaatggaagctgtattagcaatgatgataatgtttttaattgttaatttagcagtacttttaattaaaagtgctcaaaataaggctcaacaaaattttaatatgaagattacagaggtagtccaagacttggagtcaccaaagcatgcttttgaattggttgaagttagaagtgaccaattaactctatattccaaaactgaagagaaacgttattatctaggaagttatgtcaatcatgatatgttgagatatacacctggacatatgccactagttttgggtgtgcaacacgtattttttaaaaaagaaagaaatttaatccaaattaaattagtttcaaatggaaagaagagtatctcatatgtatatatcccgcctcaaaaaaagcggtagtgcaatgattacggcgttatttgttttatcttttttatctggaattagtctcttgattggtgagcaagcgcggcaagtaatactgaggttaaaagatgaacaacaaataaccaagactaagattctagcaaataagtttgtgttagagaatagaaaacaaaaaataaggtttttagatgatccgaaatatggaactgttaaaataaatgatgataataacttgactataaaagtcctaaaaggtaatactgtaaaggttgaatttaatgaaagtggctattagtgaagaggagtttataaatgaatacagaaactattgaaaagatttataaaacattcgagaaatcaattgaaattttaaaagaggaattggacgttgattttctagatgcatttattgaaacaggtgacaatctaatttctggtcaaattcatgttgaagacgggaagcctagcgaagcaattattggcgaattaaaaaaaatatatgaaggttttaagtacaatgattatagcccggaagaattacgaaaaactatccaattggttatgattcgtgctaacaaagaagaacgaattcaagtaaatcatcaatttacaccggaagcaattggaatgctttttaactacattattgaaaatttaaaagttgattcaaatcaattaacaatttttgatcccgctgtaggtacaggtaatctactatcaacaattttaaattattttcaaactaaacgaattaattttaaaggaattggtgtagataatgatgatacgatgctttcgattgctagcatgtcatttgcttttgaaagactagaggtggagctcttccatcaagacagtattgatgatttatttgtaaagaatgttgatattgcggtatctgatttgccagttggctattatcctattgacgaacggactaagggctttgaaacgagaagcaaggaaggacattcttttgtacaccatttattaattgagcaatcaatgaagactatccgaccgggagggtatggggttttcctagttccaagtaatttatttcaaactcaagaggctaaaaaattattatcatttttccacgaaaaagtttatttgcaagcaattttgaatctgcctaccaaaatgtttaaagatgaacaggcgcagaagtcaattctcattttgcaaaaggttggagctagtgctaaacaggcagaacaagttttattaggagaattcccagaattcaataatcaagaaaaaatgcttgatttcttacaagattttaagaaatgggctcaaaagaacttattttaggttttactaattaaaaagttttatgtatcattagactattaaaagtctaatgattttttaatttttgaaacatttctggggggaattgattatggaagaaaatggtaataatgagctggctcggaatttaaagagcaggcacgttcagttaattgcgattggaggaacgattggaacagggcttttccttggggcaggaagttctattcatttagcaggaccgtcaattctattagcatatattgtaactggattggtttgtttttggctcatgcgagcgttaggtgaactactgttatcagatttagaatcaacttcatttgtaacttttgtaactaaatatttaggaaaaaaagtaggattcgtcacgggatggacgtattgggtttgctggataacgattgcaatggctgagattacggcaaccggaatgtacgttaggtattggtttccaagtgtgccacaatggattccaggatttattatccttattttattaatcgggctaaacttgatcacggttgaggcttttggagagactgaattttggttttcaattattaaaattattgcaatagtggctttgattgccattggttttattatggtacttttacgctctaaaacaaacgtaggacatgccgaccttactaatttaatacattttggcggtatttttccgcaaggattgaaaggctttatcctttcttttcaaatggttttattcgcatttgttggtattgagatggtagggatgacagccgctgagactagagatcctaaaagtgtaattcctaaggctattaatgaaataccaatgcgaattggtatcttttatgttggcgcgctatttttcttaatggcaatctatccttggaatgaaattaatcccaatggaagcccttttgtacaagtctttaagaatatcggtatcccaggagcaggtggaatcattaactttgtggtcctaacggcagcggcttcagcatgtaatagttcactgttcacaactggacgaatgctattctcattaacctatggaagttcaaacaaactaggtaaacgactaggtaccttgtctaaaagtcaagtgcccaaaaatgcgattttgttatcatcgctagtgattgcagtagcagtcattttaaatatcttgatgccagaaggagtatttacactaatttctagtattgcgacaacctgtttcttgtttatctggggaacgattgtcttagctcatttgaaatacaaaaaaggtcaaaagcaggctaaaaaagaattcagtatgccatttttcccaattagtaattatattgtattaactttcctaagtttcgtgggcgttgtattattattgcaaaaggaaacggcgattgctttaattggatcattaatttggttcggtgtaatgtttacggtagcgaaaattaagggaaaaggggaactaacggattgaaatttttcacctcggatacacacttttttcataaagaattgttaaaagataaggactttgctccacgaaattttgacaatatcgaagatatgcatgcagcaatcattaaaaattggaataatcgagtgaccgatcgggatacagtgtatcacttaggggatgtggctttgaattttgtgagacctgaaaaaagggctaacgaacaaatattcagattattgaattctttgaatggtcacattgttttaattaaagggaaccatgacgcacgaagtttattcaaatatcttcaagctaataattatttgttaaatggacaatctaaatttcaatttcatgatgtgggtactatcattaagatgaatcatcgccaattaataatgagtcattatccgataatgttaggaattgtaaaacaggtaattaatttacatggtcatatccaccattacagcgtaaatattaaggaaaatattaatgtgggtgtggatactcctgaaaaagattatttagattatgcgattccatttggagcgccattttcagaatctgacatagaacaaatcatcaatggtaagaaaattgattttcaaaaaaggaagtaggcgttgacctttcttctttttttatttaggataagttttatattgatgagtggagaatttagatgagtaagaaaacaaatgaagaattatctgaaatgagaagaccggtcattaataaggttaaccgtgttagtgatgatgaaattctaatcaatgaccatgaatatcggctagaagtgaactatcgagaagcttttaatgaagagttacttgcagaacggtttgtaggattatttagtaggtatgattttttggtaggagatataggttcaggacagctaagattgaaggggttttatgctgatgatatgttagcacctagtgaaatgaagattagcagagttcaagattacctaaatgagtattgtggctttggctgcccatattttatcttacggaacatgcaaattaatgaacgtgctaaaaataagtggttgagagagcaaaagaaacttacccctagaaagaaaaatagtaagggacgtcaacctaaaaagactaaaaagagtcgtaaaccagtatcaaagagaaataacgaggttgtggggaccggtaagaagaaacgacaaaaaacatttacaatcagggagaagaaatagatgaagattaatagttacggcggatatttaattgatttagatggaaccatttatcggggaaaagaaaaaattcctgcagctaaacgctttattgaacgattgcaagaacataatattccattcctttttttaactaacaatacaaccaaaacaccagaagatgtggctaagaacttaagggacaatcatgatatcaaagcagaagcatccaatgtatacacggccgctttggctacggcagactatttggatggtatcgctgatcaaaaacatcgaaaagtttatattattggtgaattaggacttaagcgagctattttatcaaaaggttttgagatggacgaagataatcccgattatgttgttgctgggttagactatgatgttacatatcacaagtttgaaattgccacgttagcgattgaaaagggcgctaagtttattggtacgaatgctgataccaatttaccaaatgaacgaggattagtacctggtgcgggttctgtgattgctttattggaacgttctacgcaacaacaagccctatatataggtaaacctgaaaccattattatggaaaaagctttagcagtgactggattatctaaggatcaagtagttatggtaggagataattacatgaccgacatttccgctggtattaattttggaattgatactttgcttgtctatacgggagtttcaactaaagagctcgttgcaaagcaagacattaaacctactcatgaagttgatagttttgatgaatggcaataggattttggaaaagattattatatagcttgctattggatatagcagggttaagtagtgctatttttctgacaattaattctatttttttgtttaggttcactatcaatgcgcatctaactaaactggtagggatgtctacaaacaaaattatggttaattattaccaattgattgcatatctagagcttccatgggtccatagattaaaactcgatgattttcccttttctgaacatggtttagttcatatggcggaagtgaaaaatttatttatgctaaatacgattgtaatggtattttctatttgtatggtaataattctatatcgttatattgctaaaaataagaagtggtgggaattaattagcggattacaaaactcgatgatattggtccctttagtagtcatttttataagcttagattttgaccattggtttgttctctttcatcaggcattttttaataacaattattggatttttaatcccgttacagacccaattattaatgttttaacagataacttttttacaatttgttttgttttcttgttcggtttattggagttatatttagcaatttcattttgggtaataaaaaagcaggtcaactagacctgcttttttatttttgatttggcaaaggaaacaatagctggaattagggaaaccacaatgattccgattactacgagtgagaaatgctcttttacaaatgcgatgttaccaaagaaatatccagcactacagcaaattgcaacccaagctacatttccaataatattgtaacggatgaaatctttataaggcatattagaaccagcagcaacaaatggagcgaaagttcgaatgattggcatgaaacgtgctaaagtaattgagatgttaccgtgtttttcgaaaaagtgctcagcctcagccattttttcatcactaatgaatttaccaaagaaacggtgttttcttaatgccataccaacgtgtctacctagataaaagtttaaggaatctcctaataaagcggctaggcagaaaagcccgacaaaaatccaaacgtgtagtccgtattcaggttttgcggaaagggcggtagctgcgaataaaagtgagtcgccaggcaggaaggggagaattacagccccagtttcaataaaaataattgcaaaaaggagtaaataggttaaatctccgaaactatttacaatggttactaagtgagaatcaatgtgtaaaacaaaatcaatgagaacttgcaaaatatcattcctttcaaattatgaacgtatcttatatattattacatattctaaagagtattttgtatttaaaagaatattaccgtaaaattaagtattggaggttttaattatgtatagattaggagaaattgtttcaactacgatagttggaattaagccgtatggcgtgttcgtgttggatcgtaatggacgaaaaggcttaattcatgtttcagaatgtgatgacgggtatataaagaatctaagaaacactttttcaattggtgaaaaaataaaagcaatcgtaatggaggatgatggtgataaaaagttttcgttatcaattcgttctttaaaggaaactaaaggagatttacaccaatatcctaagccaagcaacttatatgttggacataagaaatattggaccaaagcacattatattagtggttttaaacccttagaaatcgccatggaacaatggaaaaaagagaaattaaattaatttcataaaattacttgacgttaggtgtgaaaacttggtattatatttgagcggcattgataaggcgcacatcgataattaaaaaacttgttaaatgattttaaaaaaaagttgttgacagtgattgttctcgatggaggcattctcgcaaaaaagtcgaccgcataaatgattaaaaatacatgcattagatttaaaatggtcgtatttttcagactaatactcttagaaaaaaacgaagcggcaacgattaggaatgaaataaaagcaatcatagccaaacaactatcatataaaatttggaatctggttctatgttttatcatattaacgtcctctgaattaatagaattattttaacgcattttgaggagctgtaaatagccaagaaaatgatatgatatgaataactaataataaagaggaatttgataatgaagaaaatactagcattacatacaggtggaacgatttcgatgtctgccagcaatgatactgttaaaactaatgaacaaaacccattactagatagccaatttatcaacaaaaatattgacctagttaatgaagtgattttgaataaaccttcagaacacattacgccagatgatatgttaattattaaaaaaagggtcaaaaaggcactagataacaatgagtgtgatggcattgtaatcacgcacggaacggataccttggaagaaactgcgtactttttagatttaacgatcgaaaataaaattccagttgtgctaacgggggccatgcgctcttccaacgaactaggttcggatggtgtgtataatttccaaagtgcaattctgacggctgcttccgatgaagccagtgataaaggggttttagtggtcatgaatgatgaaatccatactgcccgttttgttacgaaaacccatactactaatgtagatacgtttagaaccccaacttttgggccgctcggaattgtttataaacgggatatccgattctttcaagctttagttaatcagcatgtttgtgatattgataaccttgaaaaaggagtctatttaattaaagcttacgcaggaatccctaaagaaatatttgaaattattaatcgcccagggaccaaagggattgtaattgaagggctaggagctggaaatctaccagtagaagtagtcgagcccattcaagcattaattgataatgatattacggttgtaatggtttcacgttgttacaatggcttggccgaacccatctacgattatgtgggcggcggaattgatttagagagaatgggcgttgtattctgccaaggtctcaatggtcaaaaagcacgtattaagttacaagtggcagtaagtgctggtatgaattccaaagatattgctaagtatatgcatgacgcagtgtcatagaagtagataagagtataatacagagttaataagttttgaaagtgaggaattagaatgccaagttcaattaaagacgatttttatgatgcagtgaatggtgaatggctagcaactgcagaaatcccctcagatcattcatcaacgggtggatttatggacctagttgatgacgtggatgaaaatttgatgaaggattttgcagaaatgcgttcaggtgccaaagaacctaatacgccagaattaaaagaatttattaagttttatgaaattgcagctgatttcaaaaaacgggacgaagatggagtaaaaccacttcttccatacttaaaacaaattgaagatttaaagagttgggatgatgtaaatgccaacttaaaagaattattttttaatggcgtagaattaccagtagatttaggtattgaacctaatttaaagggtaatggagcagataaacgcaatgttttatgggctggtggtgtaagtttaatcctcccagataaaacctactatgatcaagataatccgtctggaccacagttgatgcaagtctttacccaaatgatgatgcaattactaacgaagttgggtaagtctgaagatgaagcccaagctataattgatggagctaaacgtttcgatgctagtattgctcctttccgtaaaaactctgaagaacttagcgatgtagctaagctttataatccatgggagtttgatcatttcgctgacatggttcaagagattgatgttaaaaaattagtccaagcattgattggaactgttccagaaaaattaattatcactgaacctaaattctacgaaaacttgcaccaaattgttaacgccgatacatttgaagattataaaaaatgggcctacgttaacatggtccgctcgttgtcaggctatttgagtgaagaattccgccaaattggtggcacttttgggcgagcattatcagggcaacaagaatcaatgccacaagaaaagagtgcattttacttagcacgtcgcacgtttagccaagtcgttggtgaatactatggacataaatacttcggagaaactgctaaaaaagatgttcatgatatggtggtttcgatgattgatgtttatgaaaaacgactggcagaaaatacttggttaggggatgcaacccgttctaaagcgattacgaagttacgttcgttgaagattttagtaggttacccagatgaattaaaagcagtttataagaagttgaaaactaaaacagccgctgagggtggaagtttagtggaaaacgttcaagaattttcacgaattttcttagaagatcaacttgctaagtatggtaaggaagtcgaccgtagtgaatggcatatgagtgctgatacagtaaatgcttattattcaccagaaggtaacttaatctgtttcccagctgctattttacaagcaccattttacagtttagaacaaaccgctagtcaaaattatggtggaattggcgcagtaatggcgcacgaaatttcacatgcttttgatcctaatggagctttatttgatgaatttggtaacatggacaattggtggacagaagatgatttgaaacatttccaccaactttcagaagcaatggtaaaagaatttgatgggattccatttgcgggtggaaaagtaaacggtaagttggttgttaccgaaaatgttgcagatgatggtggacttaaagcagcgttggaggcagctaaggctactaaagatgctaatctagaagaattttttactaactgggccacaatttggcgcactaaggctactaaacaacgagaagagttgctattagcaattgatgtccatgctcctgcaaagttacgggcgaacgtccaagtaaagaattttgaagaattttatgaaacctttggtgtaaaagagggcgatggaatgtatcttgctcccgaaaaacgagttcaaatttggtaaaaaatcaaactaaaaagacgattgctaatcagcagtcgtcttttttagttatttctaaagtaaaatacgaactataaaagtttaaataatcaatttatggcgtgctttacttatattttaaattagtgtagactttattggtgctatttttgatttagattcgaactaaaagggagaaatgattttgaaacaaatcgctaagtattttcaatttgataaattgaaaacaaactataaaacagaaattattgctggaattactacttatatttcaatggtctacattatgttcgttaatccgaacgttttaggagcatccgggatggacaagggagcggtttttaccgcaacagcactggctagtgccattggttgttttctgatggggattatcgctaattacccaatcgcttcggcacctgccttaggaattaatgcattctttgcttattccgtggttattgggatgcatgtgccttggcaaacagccttggcgggcgttttcgtagcttccttaatctttgttttaatcaccgtttttaaactacgagaattaattattaatgcaattccagtcgatttgaagcatgctatttcttcaggaattggattgttcgtggcttttctaggtttgagccaaggtggaattgtggttgctaacaaatctacgatggttggattaggttcattcttagttccttccacatggttgaccgtctttgggttggttgtgacaattttcttgatggttcgcaaggtgccaggggctattttcgtgggaatgattttaacaaccgtctttggtttattgactggtttaattcatgcaccagcacacattgtttcagctgcaccaagcttgaaaccaactttcttgacagctatttcacatgttggggatattaatactctccaactttgggtagtagtcttgactttcttgctggtaacgttctttgatacagccggcacattggttggtttggctactcaagcaggatttatgaaagacaataagatgccgcgcgtagggaaggcattgatgtctgattcagcttcaatgttgactggatcattattaggtacttctccagtgggggctttcgttgagtcttcagctgggattgctgtaggtggacgttctggctttactgtagttgtgacaggaattatgttcctattaggactcttcttctcaccattgttgaccgtcgttacttcacaagttaccgcacctgcattagtgattgtgggggtattaatggctcaacaaactcgtgaaattgcttgggataaattagaaattgctattccagctttcttaattatcattggaatgccattaacatatagtatttcagatgggattgcattaggatttattacctaccccattgccatgattgctgctaaacgtggcaaagaagttcatccattaatgtacgcactattctttgtatttattggttttattgctattttaaatgcataagtataaagtttgaaaataatcatttataataagagctatgctttaaggaagttggattaaaataaaaattcaacccttggacatagttctttttttaatttatgaggtgatttaatggcaaaaaaaagaaaattttatgcggtaaaaaaaggacgaaaaccaggactttatttaacgtgggatgcagccaaacaacaggttgatggttttgcaggagcggtatataaaagttttttgaccaaggcagaagctgaggaatggatggcaacagcttctagaaggaccactagaaaagtatcaacgcagactccatcgactgtgaccccttccattattctttacactgatggcggttcacgtaacactggtaatgtccgtggagggcatgtccgtaaagaagatgtagctgcgtgggctttcttaatccaaaaagatggtgaaagtatttctggatccaatggggaattcggagctaccaacaatcgaatggaaattatggctttaattaacggtctccaaaaaataatcgaccgctatggtgaaaaagcagcggtattagtggtagctgattctagatatgttttggatgcaattcaaagaaattggttaagtggatggcaacgacgaggttggaagaaagctaacggtgaaattgtagctaataaagaactttggcaggcggtggctagcattctaaaacgaatgcccaacctagaatatcgttggactaagggacatgctacgaatgagggtaatgtttttgtggatcaattactaaataaaactatggatagaatgttacgggaaccaaccgaatttgaagcacctaaaaaagccgtttctaatcctaaacctagtttagcggttcaagattcaacggctgattttgagcaattagggctattccataaccaacaaattagtgacgattaagttcaagggtaatattttgattatcagtttgagaagcaacagcactgaaaccaacttgttcaagtaaagtacgagcaatggtgttgttttttaaggcagtggcaagtaacttttcgagtcctaattcttcaaaactgaaaatggacatccgccgaagaacttcactcataattcccttatgttgttgatttcgaagaatttcaaaacgtacggaagctgatttctgtgcttgatcaaagtcccagatgcaaaatgtccctaagaattcatgggtgttttggtccgtaatcccccaaattaatgcttcattattcataactaagcgcatcatttggttaacgtaggtagttgtatcttcaatagttgcatcaatatcacgatcactagctttagcgatttctgaatcgtgacgcaactcaaaaatgtcacgaacttttgaatgtgtaagccaatctaaggcaaaatgttcggtaagaattggatgatatagttcaaatttattcataattgggctccttgttttttaatctttcctttactgtacactagatttgaaaaaaactgaatgaaaaagggacgatggcattcatatcatgtcatcgtcccttattttttgattatctttgttgttgtttcataaaatcattgatgcgttttaagtcatcatcagttggtttgtaggaattttccttgattcggtgtagtttttcaaccgacaaatgtgccccaaatgctacatcagcatctgttagatcatttttcttttggcagttgatgatttttgctgctagttctgtcacatcattcataatgaattcctccataagctcttcatctatagttaaaatcgtaccacaatttttacaataaacataggaattatattgtcaaaacgctgaatttatcccagtttaaaaaagttgtcggtattcattttcgaagaagctatctttagcatataccaatgaaatcggacgcgtaaggtctaaaccttgaattttgagtaatgcgagttttttagattctaattccgcttggactagagattggtacatgaaactgactccggtcgtttctaggagtttaataataccagtggaacttcccaactctagcacttgcgaaaaatcttccttatagatgttaaaagaactggcccaatcggtaaaaattgagcgggtacctgaaccttcttcacgaagtaaaagaggttccgaaagtactttttcaagtgctaagtttttttgattggtgaggggattacttgaacgtgtaacggctacaaatttttcgtgggtaacgatttggctaccatatgcatgtttatcaaagtttccttctaaaacagcaaagtctaaagtaccttcgtcgatttgagataaaatatcgcgtgtgttagaaacgatgcattgaatgttgtgatatttttttcgccaattttggattaaggccggagcgataaggatactaaccgaatgcgttactccaaacttaagattggttgtcgaaatcggctggcgtaattgggttaataatttatcttcttggtgttgagtagtttcaatgaaatgagccagttgctcacctgcactggtgatttctaaacgaggatggtgatattcaactaattttagttgtagttcaccctctaagcttttaatttgttgagaaactgcaggttgcgtgatgaataatgctcgggcagttttagtatatgacttatttttacagagtagtgcaaaagtggcataacgattatctagcatctttttcatccttataagtttaatttataaaccaattataaaacataattatattttatctaccatttttgatacgatattaagcgtgaagttaagagataggagagaagaaagatgactcgaatgataaaagattcaagtttttgggtagctatattagttacattgctttgtgcaacagcaggatcgctattggcacaattgccttactttagtttaattggagcattggtaatttcgctggtattagggatgtttgttcaagttagcccagcagtagttgagcgttctaaaaaaggtattggttttatttcaaacaagtttttgcgtttaggtattattttattaggttttaaattaaacttggttgatttagccgatgcgggtgttaaaaccattctattagcagttttcgtggttacatttacgattttaggtgtgtataccttggctcgtaaatttggcgtggattctgatctagcaatcctagttgccagtggtactggtatttgtggggcagcagccgtaatgggggtttcaccacagattcaagttcctgaagaccaacgtgaattgaaacaagaaaatgaggtaatggccattgcggcggttgccatcttgggaacgttatttacttttattgaaattggattgaaacccatgcttcacttaactacaactcaatttggggtggtagctggtggatcacttcatgaaattgcccatgcggttgctactggtggagcagatggtccggttagtttagatacggcgattattactaagttatctcgtgttttactgctagcacctgctgcattaatcattggtttttggcaccgtagccgtacaaatatagatcgcgaaaacgttgttcgtgggaaattaccaattccatggttcatggcaggttttattttagctagtgtaattggaacttttgtacctttaggcgcaactgtattaggctggttagttaaatttgcatacctcttcctaggaatggccatggctgctttgggaatgtccgtaaacttccgtgttattttcaaacgtggaaaaggtgcatttttagctgctttcttaggttcaattgtattattgattttcgtaattattgtaagtaaattattcttctaaaaaaataaaaaacgaattgatggatttgcaaaaaggagcagaatcatcaattcgtttttttaatgacttaaaatcgtcatcatgatggggaccattaccagagaaagcagcgtggtttcagttaccatgattgacgcaaaatctgcgtcagcatcgtaaagttgggcaactactggggcattggtcatcacaggcatgcaagattgtaaaataaatacttctttcatcatcatgggcatgtggcttggtaatacaagtaaagccatgatgattggagcgaaaataaatcttccggataagacacctaaattgtctttttggaaacgcatgtttttcaaaccagcgtcataaacagaaataccaatgaataacatggagagtgggatggttaatccgccaagataattaaaactcgacattagaaaattagggagtttgatgtttaagacaatgaggacaattccaatcataaaacctaatagcggagcggaaaaaatctttcgtaaagcatctttaaaattcatttgaacgtgattggaactatcacgttgaatgaagtagacgcctagtgtccaaaaaattgtggtatttgccatataataaacgaggacatagggaagacttttatcaccaaagatagctagattgatcggtaaacctacaaaaacggtattggaattgaagaacattgacataaatagtccatgtctcttaggatcaacttgaataatccgagccaccaaccatgaaattcccattaaaataaacattgatagtacaggataccaaaggttagggagcagtttaactaattcactcttagtaaaatctttagtaatcgaaacaatcatgtatggcgggagggccacttgggtgacaatcttggcgattaattttttggaactttcagaaaaccaatggagcgaagcgaggtagtaaccaacagcaaccatgacaatgattactaaaacgccttgaatactttgtaataacataattaaaaaatcccttcacaattgtttaactactattctaactcaaaattaatggtaaaattacatttagtaaataaaatggaggacattaaaatggcatttattcaaattccacatgacatgacagaactacggattatgatggaacaactaaaagaaatgggtaaagaggctaatgaggatcaacttatcgaacaagcagtggtcgataacgcgcaacagttgttagatgaagcgcttgatggacactactttacctgtaagttagaagatggaaaattagtcgtttatgatgtgatcaatttaccaactggaagtatcgaaccattaggtaaaaactttaaggaagactttattactgacgcggataacctttggattcatctttcaagtaatttaaaccgaattgcgggcggacgttagttaataggaggaaccgatgagtattcaattaattgcaagtgatattgatggaacttttttgaatgaccaacgtgattttgatcatgatcgttttcaagcgcaacttgatgaacttaatcgacgtcacattaaatttgtggttgcgagtggtaatcaaatggcccactgccaagaggtttttgccgacgtaaagggcgacatgacttttgtggctgaagatggggctttgacgatggaacagggaaaaattttggatgataatccgctgaaacccgctttgttgagggatgcaatagaatatttattgactacgccagcctttaaagacgctaaaattattctttctagtcaacatcgggcgttcactaatatggaaaagagtggttccgactggtccgcgagtgcttatttctacagccagcttacaaccgttgatcattttaaagatatcacggatccaatttataaaattgatacgcattggaccaatctcgaagatgttcgagaacaagccgcaatgttgaaacgagaccttggaggagatttaggaagtgtgatgagtggtttcaatggaattgatattacaatgccacatgtcactaaagcatacggtctccaacaacttcaagaattatggaaagtttcgatggatgaaacgatggcctttggggatacccaaaatgacgaagctatgttaaaacatgcccgcttgggttatgcgatgaagaatgcagaacaagaagcactcgatgctactgatttaattacaccgctggataataatgatagtggtgtattggatatgatcgatcgagtgcttagtggtgagattgcataaaaccatgtaaagtaaattggtcgaatcaaatagacatactttaaaaatatcttgacatttccgattattctcagtatgattagtgaaaattaaatcgagtcgctttaagttaatccagagaggttaataagctagcagagtcgccatcaacaggtggagtggacgcggttagcgccggcccataccaacttgttggtggctttttttgtacccaaatagcgatatcgaaaaattaaaaaggggattcttgattatgaatgacgaacttcgtagcaaaattatccagcaactacttgatttaaaggcggtttcgatttcacccaatgcaccgtttacttatgctagtggaatgaaatcacccatctatactgatttacgaatgacgattagcaagccagttctacgttcagatattgctaaaggattgagtgcagaaatcaaaaaagcttatcctagtgctacggtaatcggtggggtcgcaacagcgggaattccgcacgctgcatgggtggctgaagagttaggcttgccattaatctacgttcgatccaaacccaaggatcatggagctggcaaacaaattgaaggtcaactcaaagctgacgatcaagtagttttaatcgatgatttgatttcgacgggtggtagcgtacttaaagcggttgaagcggttcgtaaagaagacattcaagcaattggagttgcttcaatttttagttatggtttaccggattcaactaagaattttgcagaacaagatactgaactacttagtttgctcaactacaatcaaatggtggattatcttcaaactagcaatgccttatccgctgaagaggtagcttcggctaaggagtggcatcaagatccatggaattggaaaaaatagaataacactttgtttcaattaaatcggtttcccgagaggaaccaattgaatcggctttttaagctactcccggcgagacgattcgattggtgagtagctttttttataataatttaggaggaaaaataatgaatatgcatgacttaaccactgtagaaagctttagtgaagaggacgtgttacataaaattcggttatctgaggaatttaagaacggtaagacaattgaacttactcgaccggtctatgcaatgaacttattttttgaaaatagtacccgaactcatactagttttgaaatggcagaaagtcgtctaggaatgcgactccttgagtttgaagctaaaactagttcagttactaaaggggaaagtttattggatacggttaagacaattgatgcaattcagacggatattgcagtcatccgtcatccgcaaaacgattattataaacaactgctagaagccgatttgaatattagtattgtcaacggaggcgatggaagtggacaacatccttcacaatcattactcgacatgatgaccatttatcaagaatttaaccactttgacggtttaaaaattgcgattgccggagacatcgcacattcccgagtggcccgctccaatgcaatgctattaaacaagctgggtgcagaagtttacttcgccggtcctgaagcatggatggccgaagatttgaaggcttatggaaccttcctaccaattgacgaattagtagagaaagtggacgtcatgatgttactccgaattcaaaatgaacgtatttctcaagataccgcaattaaatttgaaccacacgaatatctccaagaatatggattaaccttcgaacgagccgatcgaatgcaaccaactgctatcattatgcatcccgctccagttaatcgtggtacagaaatcgaaagcagcttggttgatggagaaaaatcaagaattttcaagcaaatgactaatggaatgtacatgcgcatggcaattttaacggacgtattagaggccaagggattgattaagggaggattgcattaatgaaagttttacttaaaaatgcccgagtaataaaaagtcatcaagtgcaaaaagctgacgtccttgtggaaaacgaccgaatcactcaaattcaacccgaaattaacgttgaagctgaacaaatcatcgatgtaaaaaagcaacttttaatgccaggactggtggatatccacgttcattttagagacccgggccaaacggataaagaagatgtagttagtggcagtgctgcagcagttaaaggcggatttacgacagtattaactatgcctaacgttgatcctgtccctgatacacccgaaaaaattatagcgatggtaaaacataatcagactgctggtagtcttcatatcggacaatacgggtccattactaaaaaacggaccagcgaagaattggttgattttaaagctttaaaagaagcaggtgcagtagcttttagtaacgatggtaacggcattcaaactgccgaaaccatgtatcaagcaatgcttcaaattaaagaagtggggctaccactggctgcgcatgtagaagatgaatcactaatgcaacatggggtgatgaatcaaggaacggtagccgaaaaattgggtttaccaggtattacagaattggcagagacagctcaattagcacgggaccttgaaattgcgcgtaacacaggcgctcattatcacgtttgtcatgtttcaaaagctcgaagtgtggaattaattcgccgtgctcagcgagacggcgtccatgttaccgcagaagtcgcacctcatcatttatttcttgatgaaacgatgatttcgatggataaccccatgatgaagatgaatccgccactacgaaccttggaagatcggcaggcactcttaggggggctgctagatggcacaattggtatgattgcaacggatcatgctccgcacacggtggaagataaggctggatcgatgaagaccgcctcttttggaattacagggttagaaacagctttcccactactctacactaagctggttaaaccgggactttgcacggtagaacaactagtggaacggatgagcattcaaccagctgaaatttttaacctcaaggcagctgggcaattggaagtgggagatgtagctgatttaacggtaatgaatattgaagatgaatatgaaattaaagaagcagattttgcttcaaagggaatcaattctccgtttattggtcaaaaggtttatggacagacacaactgaccatggttgctggaaaaattgtatatcaacgggaagggtaatttaaaatgaaacgttatttaattttggaagacggtactacatatgaaggaaaggcgattggagcaaatcatgaaagtattggagagctagtttttaatactgggatgtcaggatatcaagaatcgattaccgaccaatcatataatgggcaaattttaatgtttacctatccgttaatcggaaattatggcgttaatcgagatgatttagaatccgttaagtcaagttgctttggagtggtagtccatgaggtggcacgtcgagctagtaattggcaaatgaatatgagttttgaagaatttttagtatatcaagatttgcccggtattagtggagtggacacgcgagcaattactagacatattcgcgaacatggagcgatgaaagcagcattagttaatgaaatttcagacgctaagtttgaagaatttcatgcaactaatttgatacaaaaccaaattgaaattagctcaactcatagcccataccctaatccagccaacggtcgtaaagtcgtagtaattgattttggactcaagtattccatcctacgtgaacttgctcgtcgcgactgcaacgtaatggtgcttccatatgatgctactgcaaaagaagttttggcctgcaatccggatggagtgatgtttactaatggacctggcgatccggaatcaatgaatgaaagtgttctagaaatgattcgcacggtggaggctgcggttccagtctttgggatttgtatgggacaccaactttttgccctagcaaatggtgctaagacaactaagatgaaatttggacatcgcggttttaaccatccagttcgcaacttagcaacgggacgaattgatttaacttcccaaaaccatggttatgcggtcgaacgtgcttccattgcaaacactgaccttgaaattacccacgaagaaattaatgacgaaaccgttgaaggactcagacataaacaatataaggctttttccgttcaattccatccagatgctgcaccgggtcctcatgatgcggactacctttttgatgattttatggaaatgattgatgaagctaaacaaacccaggaggacaagtaaacatgcctaagagagaggatattaacaaaattttagtactcggttctggacccatcattatcggtcaagcggctgagttcgattattctggaactcaagcttgtctttccttaaaagaactcggatatcaaacggttttaattaattccaatccagcaacaatcatgaccgatacggatattgccgataaagtttacattgaaccattaaccttacaattcgtttcgcaaattttacgtaaggaattaccagatgctattttgccaaccctaggtggtcaacaaggattgaacatggcaatggaattatctgaagctggaattctggacgaacttggaattgaactgcttggtacgaaattagatgccatcgatcaagctgaagaccgggaacgtttccgagctttgatgaacgatttgaatgaaccagttcctgattcaggaatcgcaacgacggtggaagaagcagttaactttgcggatcaaagtggttatccagtaattgtacgtcctgcttttaccatgggtggaactggtggtggaattgcacaagatgaagctgaactacggaagattaccgccaacggtttaactctttcaccagtaactcaagttttaattgaacaaagtatcgccggactaaaggaaattgagtttgaagttatgcgagatagtgttgataatgccatcgtagtatgtaacatggaaaactttgatccagtaggaatccatactggtgactcaatcgtttatgctcccgttcaaacgttaacagatcgtgaagtacagatgctacgggatgcttcactaagtattattcgagcattgaagattgaaggaggctgtaatgtacagttagctcttgatccagcccaagatcgttattacgtgattgaagttaatcctcgagttagccgttcgagtgctttggcctctaaggcgacaggttatccgattgctaaagttgctgctaagattgcggttggattgaccctagatgaaattttaaacccagttaccgggactactttagctgaatttgaaccggccttagactacgtagtttgcaagattcctcgttggccattcgataaatttgttcgggcagatcggcgtttgggtactcaaatgaaagctacgggcgaagtaatggcggtagggcgcaacgttgaggaagcaacccaaaaagcaatccgttctcttgatatagatattaattatattggcgatgaagaactcgccgatttaaatgaagcagacttagtcgatggcattatccatgcgcgtgatgatcggattttttatctgtatgaagcaattaaacgtggatattctgtggataaattagctgatctgactaagatcaacgtttactatttggataaattattgcacatctacgaaatcgaacaggaactaattgctacgccatttaatgctgatgttcttgagttagctaaaaagaatggtttctcagacgaagttattggcaaaatgtggaaaactaacgaaaaagaagtacgagcatattgtgaacaagtgggattatcacctgtttataaaatgattgatacttgtgccggtgaatttgaatctcaaactccgtattactacagtacctacgagctagaaaatgaaagtattgtctcgaaccgcaagtcaattgtagtactaggttcaggcccaattcgaatcggacaaggggttgaatttgattatgctacagtgcattcgattcaagccattcgccagatgggttatgaagccatcgtagttaataacaatccagaaacagtctcaactgatttttcaatgtccgataaattgtactttgaacccttaactgtggaagatgtgatgaacgttattgacctagaaaggccggaaggagtaattgttcaattcggtggccaaacagcgattaacttagccgaaccactcgctgaacggggaataaaagtttttggtacaactgtggaaaacgttaatcgggccgaagatcgggatgaattcaataagctaattcaggctaatggtattcgtcagcctcaaggacgtacggcgacaacaacatctggagcaatcgaagccgcagaatcaatcggttatccagttttagtccgtcctagctacgttctgggtggacgggcaatggaaatcgttcatgccaaagaagaacttgaaaattacatgaagaatgccgttaaggtttcccataaccatccggttttggttgatcagtatttagttggtaaagagtgtgaagttgatgtaatcagtgacggtgagaacgttgtgattccaggaattatggagcatatcgaacgttctggggtacattcaggagattcaatgacggtttatcctgcgcaaactctttctcaaaaggtccaagatgaaattgtgaaagtttctatcaaattagctcaatcgctcgaatgtatcggattgatgaatattcaattcgtggttcataatgacgaagcttatgtcattgaagttaacccacgtgcaagtcggacggttccgattatgagtaaggttactgatttaccaatggctcgccttgctacgcgtgccatcttaggtgaaagtttggtcaatcaaggtttgaagcctgggttgcatccagctggtgaaattattcatgtgaaagcaccagtcttctcctttactaagctagataacgtagacagtttattgggacctgaaatgaaatctacaggagaagtcatgggaagtgaccgtactatggcgaaggcgctctataaagcgtttgaaggcgctaaaatgcacatgccagaccatggcaaagtcttaatcacggttaaagatgaagataagggagaagccatcgattttgcccgacgtttttgggaactaggttatcaattggttgccactaaaggaactgctcaaacacttgcagcacatggtctgaaagttgagacggttggtaagatgactgaagaaaataacattgtagaccgaattcacgatcatcgcattcaaatggtgattaataccatttcagacagtactactagtgctgccgatggaatcaaaattagaagtaccgcattaacttatggagtaccactttttacggcattagataccgttgacgctattttacaagtgcttgaatcacaagcttttacaacattacatctttaggaggaaaacaaatggatcgcttagaaacgacaattgccggagtcaagttgaaaagtccggttatgaatgctagtgggacggctgcatatggacaacaaatggctaaaaatattgatttaaatgaactaggagcattcgtaattaagtcgacaactatggagccgcgtgcaggccatccgtggccaactaccgcggccaccactggaggctggctgaatgcggtcggtttgaagaatcctggtattgaacatgttttagcttacgaacttccttggttagctgaaaattatctggatctccccattgttggaagtattgctggttctaatccggatgattatgttgaggtagctaaacgcatggcgactgccccgaatgtgaagttcattgaagttaatatttcatgtcctaacgttgataagggtggtctagcatttggtactgatccagttgtagttgaagatatgacccggcgcatcaaagcggtagttcctaataaacccgtcttcatgaagttaaccccgggagtaactgaaattgttcccattgctttagctgctgaacggggcggtgcagatggcttagtaatgataaataccttaataggaatggaaattgatttagaaactagaaagccacgtctttccaatgggacgggcggtctttccggaaaagcgattcatcccatcgcagttcgcatgattcatcaagtacgcgaagtaactaatttaccaattattggggttggaggggtattttctgctaaagatgcgttagaattaatggtagctggagcaggggctgttcaagttggatcagcaaattatggtaatccacatgcttgccacgacattattcaaggcttagttccagcaatggatcaatatcattttaacaacattgcggagtttagctccgagaaataagcggaggtttagtagtgactgaacgagtagaatttaaaccaacaagtattgatgatttaagtagccaatatgatgtaattattatcggagctgggagtacgggtttaaccagtgctctagaactgactgagttgggcaaaaaagtggttgtcctagagaagatggagaagcctggtggaaactctatgcgggcatcttcagggatgaacgccgctgaaacagcaatccaaaggcatgaagggattatcgatagttatgaatccttttatgaagatacatataaaggtggcggcaaacaaaatgatgtcgaaatgttgaaatattttacaagtcatgcggattctgccgttgagtggttaaaagaacatgatgttgttttagatgaaatcactttgaccggtggaatgagtgtgaagcgggcccatcgccctagtagcgcccctgcaattggtggatatttaattcaccaactactaaataagttagctgaagaaaaggttccagtagtttgtggagcaacggttagggaaattgatcgtggggataatcatcaatttaaagttgattttgccgacgcccaaggctcaaaccatttacttaatagtgcagcaatcattctagccacgggtggtttcgctgctagtgatgctttaattaaaaaatatcgtcccgatctcgttcactacaagacaactaatcaccctggggcgactggcgatggattacaattagcggagaatttaggtgctcaattggtagatatggaccaaattcaagttcaccccaccgtttaccaagatggagaccatgcattcttaattggtgaaatggtacgtggggaaggcgcaattttagttaatcaaagtggtcatcgatttgtaaacgagctagacacacgtaaagttgtaacggatgcaattaacgctcaaaaccaaccagatgcctatctgatatttaatgcagcgttagctaaaagagccagtgcgattggtttttacgctcacatcggtctagttcaacatggtgatcatattgatgagttagcgaagactttgggattaccagttgctaatctaaaagaaacgatgcaacagtggagtgatgtggttgctaagcgtaaggatgaagcattcggaagaactatgggtttggttgatggttttgaagaaggtccttatatggcaattcatattgcaccagctattcactatacgatgggcggactcaaaacgtctgctaaagccgaagttttagataaaaaatttaaacccatcaaagggttatatgccggtggggaagttgctggtggattacatggaaataaccgtatcggaggtaactcaatcgccgaaacagtggtttttggattgcaagctgctcgccaagcattcaaaaatttataatagatattatgtacaaatatatatataaccaaattaaaggtaagattttgttaaatgttccaattgacaaggtcttgccttttttagacaatcaatataaatatgctttttttataattattattagtacaataatttttgaagagtaaaacttttgtaaaggagaaaactttgagaagaaaaatcatttctttaggaatgttgattggatgcatcttaatcttagttggttgtggacaaaaacaaccacaaactaagattcctaaagcagacgccgatcatttaaccattacaacgcagtatcataaaaataaacaaaacattgaattgttacataattttttaaaagattcaatggttcaaaaagctggtatctacacgaattttaataataatcaaaaaaaatccgataatgccacgggacatgatatgttatctgaatcatcaggtttatggttagaatacttggcgcaaactcatcaaaataaggcttttcgggagttctacaaaaataccaagaaatattttgatcaaggtcggcaatttagttatcgcatcgaaggtaagactaagaaaaagtccgatgtgaatgctacgctggatgatttaagaattattcgtgctttacagatttatgcgcaaaataataatagtaaaaaatatcgacacgaagcggctgaacggtttgctatgctacaaacgacaagcattcaaaaagcacgggtacttaatttttatgatgtacgtactaaaaaagctagtaacgaaagttctttagcctactatgatttggctaccctaaagtactttgaatctgtatctaaaaaagagcggggatattatcgagaacaattaaagctagttgaaaaaggatatctgggagatatttttcctttgtacgctccgagctacaactggaaaacaaaccaatatggcacgaaaaatctgaatacttcagaagctttgattacagtcctgcatttggctgaaattggtaagatgaaacctgaaacagtcagctggttaaaaatgcaaattgataataagaagttatataacagttacactactgctggagcaatcgaggaccataaccaatcaacaggtaattatgctatagcagcaatgattttcgccagaaatggtgatcgtaaatattatcaaaaggccatgaacttggtttgggatgatcaggttcgaaataagaattcaaaaatttatggggcattaggtgatacaaaagataatgacgcttactcatttaataacctattggcattgttaacatcgcaatactaaaggatgggatgaaatggtttcgattaaaaacagttggagggtatttcaaaaacatatatcacctgctgccgttgcaacggctttggcagcgattatttgtgctgtcattctctttataccaccgattaatggctatgccgataatggagatttttatcgggcaatgttaagtaacgggatttatcgactaccaaccaaggataatcagtatattggttatgtggtaactaagtttgggattttaaagtattttaatgaaaataacgttgctgttttttcatctcaagcgcttttcgttaaagtcgctgtaatactaaataagttattttatagtcatcgttactttgatattcgcttcttaggtatcgtctattatgtagcttttttacctggtatctacctattaactaaagcattaaccggaacttggcgacgtatacgaagttatgtgattgcaattctagtagtacttatctttgcggatgcttcatttattctgtattttaattcctttttcgctgaaccgggaatgttaatttcattcttgtatgtggtagggtctctcattttattagcccgtggagattattctaaacgctggaaattgttattaacctactttattagtgttgtggtcttaattactagtaaacaacaaaatgctcctttagcactaagttttggagtcatgtcagtggggccctttttcctgcccggtttaaaaaaggctaagaaattagctgttatgggtggtgttgttgctactttgggagcgggagttctgacgtatagtttaatcaataaagaattcaacgacgttaatcaatatcaatcattttctcatggagttttgatggaaacgggagatccgagtaaaaatattgccaaaagtgggctgagtgagcaatttgccttaatgcgggagcaaaactattatgctaaaacttttgataccgttgacccaagttctcactacgttagaaaacatttaattgaaaaatacaactttgcgtggattattaaatattatgctagaaatactgatcaatttttacgcttactagatgtagctagtaaggatattatggttactcaagtaaaggcagtcggcgattataccaaggattctgggaaaaaagcgggtcaacagagcaccttttttacactttatagttcgctgatggaagctttctttccaggaaaatatgcctttttgtgtctcttggctatcacatttgtggctgtatatgcagttagtgcttatattgactttgtagctggaagattatttggcgttgtacgtttttttctagtgctgggattgatgaccatttgtgtgtttgttccaattgtttcaattattggtgatggcgatgctgatttagccaaacatttattcatggtccctctcagtttggactttaccttcataatgtttatttcagacattctaaatcatcaattatggctaactgaacaggaggaagatggggatgcgtaaaataattatgttttttttaacgattttcttcatggcccttggcggagtagttcaagccacccgaacagcacatggtagtgaacgcgatgataatcgtgttttgctcgtttatgattctcaaaatactatcgaacaggatgaaaaaaagattgataccttacagcgaatgttagcagggatgggacttaaagttaagacagttaaaggaagtgaatatcaaaaaggtgagttaaaccatagttatcaaggggtaattaccatgattaactggaaacaagcgtcactggataatccaactttcgttaaagatcgtaatcaatatgacggtgttaaacttcatattggtgaaagcttagatcgaaccgaacaaaaacagttacaggttaagctaaagacgatttatcaacaacaattcattttaagtgaagatagcagtacagaaatgttgccatttgtggaacgcatggatgttttaactggagttccaaaacaagcacagagttacggcatgttaaagacgcaaaataatgaaggtcaatcctataagtatggggtaattaatcaaaaacaaggttacttgcctttcttcaacaataaaggactgggattaattacagctagcaagatgatagctattttatttaatcgtcaagaagaaaccaaaccgttgttaacgattacggatgtttcaccttatagtaatctaaagctgttagatcaattaagcgtattctgtgaaaagcatggtataccattggcaatcagtacttccacagtagctaaaaacacggaaatgcacgcgtataaaaggtttaccatgtatttacgtagacttgaagatcgaggcggtgtgattttcttacaagctccggtgattgggggagctactgcgaataacgcaggagaattgagtgaattatttgataactatctacttaatttggcacaaaatcaagtttatccagttggaattagtgctcaaggtttttggaatcaggatcgagtcttgaggaatagtgctttgaaaaaagctaattatcagatgctacttcctaataaaaaagtagtttatctcgatcaagataatcaaggtggcaccaatagccgaagttatttagcattaccagcctcaagttttaataaaattaaacaccaagcagatgtacgatttgcaatgcccacagcgctaacttttaagatgcctgatagtaaggttaagttgaaaaatttaaaagaacaaattcaagcgttgaactttgaatggcaagctccggatgaagctattaattcaaaaattgattttgcaagttcatcacttgcttttcaaaatggacagtatttggtgaatggtaaggagacggaagttgaagttaattcaagtatggaaaatactgataagccaactcctacgccggcgctatttaaaggctttttcagagttgaagggcaaattattaccgtgttcttcgccattatctttaccgtcttaatcatttttatcgcctttggaagaaaaatttacaagaatatgttcaagagataggaggaatgaatcatcacaattttggattttttcctaatggtagctatcattgccatttggggaacgttaataattaatttgattttaacggtagctggatatacgtggtatctccaagaagctcccaaaccggataagcaacttcctgaaaagattccctttgtgacggtaatggtacctgcacataatgaaggaatcgtaattgttaaaactgttttatcgttgctcagttttgactacccccatgatcactatgagattattgtgattaatgacaattcaagtgataattcggcagaattattaaaagaagtccaaaatgattttggcgaagaacgtttgaaagttattaatacagacaatgtgacggggggcaaaggcaagtccaatgccctaaatattggtttgaagcaagccaaaggaagtgttattgcaatttatgatgcagataatactccagaacgtggtgcacttcgtcttttagtagcagaacttttaggaaatgaccgtttagcggcggttattggaaagtttagaactagaaataaagaagcaactattttaaccagatttattaatattgaaacactttcgtttcaatggatggctcaagcaggacgtcaacggctgtttaagctatgtacgattccaggaaccaattatgttattagacgcgaaattttagaaaaaattggtggttgggatgttaaagccttagcggaagatacggaaattagttttcgggtctagatgggatatcaaattaagtttcagccgcgtgcggttacttgggaacaggaaccacaaaccttagatgtgtggttccatcagcgaacgcgctgggtgaaaggaaacatttacgtggtcgttaaaaatgccaaattactctttaaaaaggccggacgtcccattcgctttgacttactctatttcttgtcaacgtactttttattgatgaccgctttgattctatctgatgtagtttttgttctttcagtcgctgggttggctcattcagatttacaaggttttagtaatgctttgtggttatttggaataataatgtttatcatcagtacctttgtcacggttacaaccgaaaagggtgaaatgcgttttagcaatattctttatattatttttatgtatttggtatacagtcaaatgtggttagcagtcgcagcatacggaatggtggggcatattcgtgaacaagtctttcataaacaagcaaaatggtataaaactaagcggtataagtaaattaattattttaacattaacgatattattaatgtcattagttggcgtgggccaagtacatgctgaagacctaacttatactcaaaattttcaaaatgatacaacaactttatctggtaaatcaacagcaacgagcatgtactttaccaagatggattattggaacgttaaaaaagctacctttaattttaattatcaagtttcacagttagctgataaaacaacgtctgatatcacgttatcaatgaacggcgttaaattttattcatttcgtccagagcataagagtggttttcagagtaaagctgttgagattccgctagaactcctgcaaggtactaataaacttgaaattaaaggacaaattttaaataaaaaagatgctaagaattatgatttagcacaaactccagctaattggctaacaattaagtctggtactaatatgaattttaaatatgaagtaaaagatccagaaaacacattgcgttcattttatgatcatttttctggtgaagatacaatagctaatcagcactcaaaaattgtcacccctgatcaaccaattaaagctgaattagcggctggtatgactgctctaacaggtatctcgcacgcaactactacaaacaataaccaaatcagtgttgtccaaaatacaaatatggatgctactaaaggtgattatatcttgtatgtcgctaaatatgataatcttcctaaagctttgaagcaggaaattagcgaaaaagacgttgagaaaagagcggtaattaaaactcactatactaaaaaggtgattatttaattgtaacggccaaaacagatggcttattaaaaaaggcttcccagttttttgctaatccagaactaatgcaacagacgaataagagtacagaaatgatttcgtatttaacaaatacctttatgtctaaagttcaagatagaggtaagtatcaactaaccaatgtcattgataagattaaaggtgctggacatcatgaaaccaattatttggtaacattgcctaatgaccgaacaaacgctgatgggtccgaagtgaaattacattttcgatatagcaaaaaccttaacttcaaacgttccttagtgacggtgtacgttaacgatacaaccttaggaagtaaaaaattaaccgctgctaaagctaatggagacgaagttactttggaggttcctaaagggacttccttaggaaacagctttgaagtccgagtagcttttgatttggaaatgaaggatcaagaaatttcagataactctgaaaccccttgggcagaagtagatacgaattctgaaatgaaggttaaatcagaaaagagtaacgatttactctttaccaactatcccacaatctttatgaagaaccaaacatataacaacttagcagtggttatacctaaaaaattaactgcgatagacttcaagagtttaacaaatatttttaacttgatgggtgcttacgctaagagtaatactggaaaaattaaattttatactgaacagcctaatcaggatacaatgattaatgataatttaattgtacttgggaccccttctaataatgcaatgattaaatccttgaataaagatttgtatttcaaatattctgatgactatcgaggatttgtttctaatgaaaagctcagtattgaggaagattacggtaagacgattggaacagcgcaactaattcgttctcctgaaaatagtaaaaagggcattctagtcctaacgggggctactccggaagccagttatctagcttcgacacagctcaattttaaaaagaatatcgatcaatttacaggcgacgcaattgtggtagatcaaaataacaaccactatagctatcgcttcaaggaaaacaagtatattgatcgaaatttagaacacaagcggaccattagtaataatagtcaattaattatttatttgggaattgtctttttagctttgattgtcattggttttggagtttacctagtttttagaaagcaagccatgatgaatggaggacgtaagaatgcaaaacaaaaatagcaaagatcgtttgtatgaagatattggtctactcctacttttattaatgcttagcattacggccgttttgatgatgctttctcaaaatatcgttgtgaatataatttatttaatcatcactatgggaattttaattgtaacttactttatgggaattattcccagcttattagcaaatatggtgtttattgctttccaaaccgtagttatgttgtatgaatattttggtttgaatcacgaaattcagtggtcgttgcttttctggctaatcatgccgttgttgatttcactgaccatgtatctttcaacacggagtcagattgcgttgcaaaaggcgaatagtgatttacatgcggctttggtagagcggggcgcctttgatcaacaaactaatttgcggacgatggttgcatatgtggaagatgccggagtatttattgaaactagtcgacgctttgagattcccgtatccacgctaattattaaaataagatattttaatgatttacggagaatgatgagtgatcgccaacttcagcttttattacaaattgcttcagaggtaatcaaaagttcgacgcgtgataatgatattacctatattttggaaaatgaagatccaacgtgggcgattcttttgtacactaatgctactggaggaagaatcgctggacaacgggctaaagatgcgtttgaaaaacggattaaggaaagcccagagttagtgaatctcgctatttcaatggttgtgggtgtttcagaatggaacgcagaggaaatgagtaatccatatgatttaatgaatgatggaattaaagaaactcaatatgatgtttagagcagcataaaaaagaaccttaacttcagaaaaagaagttaaggttctttatttttattagcaaattttattaccgatatctttcatatctttagcgagttcgtccttagtttgggcatctgttggttcgtaattttgaacagtaacggcaccatctaagatgctactatcatcactgagtttaagcagtcccattttataatctaattttagcccattacctaaataattagcctcttctttactagtagtaagattaagatccgcatcgttttcaattgtatccgtgtaagcttgatcaggaacagatgagataactagttggaatttattaccaatagcacatgatccacctaattttgaaaatttactagaaccatcatcaagtgctaagaagatatgcttaccgtcgatatctttctttaataaataatcttttgtattctctgtaatattaattttcataataaaattcctcctatgcgtaaaacaaacactgagctcctacgacttgatattaccttaatttaaaacagaagttaaatattgtgctcaggatttggttcggtaaattaaatcagttgttctagctagcccttcaggctaaaatgaaggaaacaagttttggggaggaaccagatggaagttagggctgttaatcatatcgcaattatttgtacagactacgttttagctaaagaattttatgttcataaattagggatggaagtagttgcagaaacggaacgcgtagatcgaaacgacgtaaaactagatttaaaatatggagatttgatgtttgaaatttttatcaaaccagacgctcctcagcgggtttcatatcctgaagcagcggggctacgccacatttcgtttgctacggataacatcgaaaaagatgtagactatttacgttccgtcgggattaaagttgaagatattcggcgggatgaattgaatcagcaaaagatgacgtttttcttcgatccagatgggttacctttagaattacatgaatgataccaaggcagagttacgataattaattttatcgtaactttttttgtatgaaaacgtatttttacacgtgtctaaatttaaactattgcaaaaataaatatgtggagctagaatagtttatcgagaaaaacatttttggagggaataaatgaaatatgatttgacgaaaaaatcaaccaaaggagcgcaaagaactttaagagcattttcggatgcgatgtataagctactagcggaaaaatcgtatgacgatattagcattaatgaaatttgtaagattagtaatttcccgcgggcaactttctataactattttgaagataaaaaagatttattgaattattgttggttattattcaaagaagaaagcaatattgagcagtatcatgacgttgctgacgaagatcttcaagaatatgtattgggtcaaatctttgaggccatggatcagcatcgggaactattaactcaattagcaaagcataatgctaataatagttcgatcgtgagcagcatttatgagtactttaaaaacgaggctattacgattttaaagcaacatctaaaaaatcaaacttcgaaagtaccactagaattagtagcaaagcattatagtaatacgattttgttggtacttaagtggattttcatcgagaatcatccattgtctaagagagaagcgatggaatatgttgatgagttactaggaaaataagcattaagagaagagtgaattgattaattatagataggagagaagagtatgagtaagtatatcaaacaaaacattgccaagtttgtgacttggattatcgttttgattttaggaatcgtaatgttacctaatatttctagcttagtagctgaaaaaggtcaaaccaaaattccggatacggctaaaagccaagttgctaaaaccattcaaaaagattggggccacaaaattagcaatacgcgccaggtcgttttggtctttaataatggtgaccaagccttaacccataagcaaaaagatcgtatcaatgacactattgataaaatcaaagataatgaatctaagtatgatattaaaggagttactgctcctaacgatagtgaggcaactaagaagcaattaatttcaaaagataaatcaacccagatagtgcaactagatgtaggtaagcgggattcagtgcggaagatgaatcaaaagctggttaaagaagttaagacgagcggagtgaaaacttacgtaactggtagtgatatcttaaatgatgatttctcggtagccattgaagagggtcttaaaaagactgaagttattgccatcgtcttcattttgattgtgctaattctagtcttccgttccccaattgttcctttaatttctttaggaactgttggactatctttcatcgttgctttatcagcagtgatgaatttagctaaatatacaggatttacgatttcaaactttacccaagttttcatggtcgttgttatgtttggaatcgggacagattacaatatcttactctataaccaattcaagaatgatttgattgaggggatggataaagaaactgccacgaagcattcacttaaggtggcaggaaaaacgattctttattcaggaagtaccgttctattaggattcttgactttagcattggctaagttctccatttaccgttcggcaacgggggttggaattggggttgctattttactactagcattattgaccgttaaccccttctttatgtcactactcgggaataaggtattctggcctagtcataattcaaaagaatcaaaccacagtaagttgtgggattggctttcaggacactcagctaaaaatccattgattgctttaggcatcatcgtaattttagcaattccaatgctgttaacttataacaataaacttaattatgatacagtcgttgaactaccagctaattattctgctaagcaaggatttaagacggtgcaaaagcactttagcaaaggaacggcggaacctactaccatctatatcaagagcaatcacaagcttgataatgaaagtgatttaagagttattgataacttaactaaccaaattaaaggtattgatggaatcaagacggttgcatcagttactcaaccaggtggcgataagttagatcagctttatgttaatgatcaattgaagacgttgacttcccaaacaagcaaggcccaagcgggcttaaaagaacttcaaaaaggtttaactggtggagattttgatgctagtcaacttgaagatatcggtgctaaagcgaccttaattgggcaagagttgaagagtatccaatcaactagtggtagctctgtaagtggtcaacaattgatgacggccttacaacaaaagatggcagcggctggtcaaccattatcacaaacacaaatgacgattctttctggagcagctagccaagaaatggcttcagtaagttcaatgcaaactcgccttcaagcaattgccacttatacccaagcaatcggtaatgatgctcaaactcttgggaatgaacttaagggacaacaacaaaaaatggcaaccgctggtggcagcgttggtaaactaaatgacgggctatctgaatccaatgattacttgaaagaacttcaagattcatctgcatctaacacattatttgtgcctaaagcagtgttagaaagtgatacatttaaagattcagaagatgtctacttatcttcaaataaaaaggccgctaagatcacggtggtcttagattcagatccattaactgctaagtcgattaaaaaagttgaaagtctgcaaacgatgattaacaacaacatcaagggaacttcattgaagaaagcttccgtttcgattggcggtcaaacttctgaaacttctgatacatcaagtattgctaatcaagatttcttacgtagtgcagtaattatgttagttggcattacgcttgcattgatgttagtaacgcgctctatcttacaaccattctatatcattgcttcattgctactagcatacgtaggtggactaggaattacacgctttattagtagtacattccttggtgaaaatctattaggatggaatgtacctttcttcacctttgtaatgttggttgcccttggagtagattacagtatcttcttgatgatgaagtaccgtgaatttggtaacgaggatgctggaggtcgaattgttaaatcagcaggaattattggaacggtggtaatttcagctgcaattatcctagggggaacatttgctgccttaattccagcaggagttctgaccttgacacaagttgctgttggggtaattagtggtctggttatactagtcttcttaattccagcaatgaatagtagtttaattcgtttaacttatccaagaaaaaattaatcataaagtcgtaactctatttggggttacggctttttatttgcttacgattaataactcgtttattctgggggtataaataattaggtgaggtgatgtttcatgaagattgggattattgcggcaagtggcaaagccggcgcattgattactaaagaagcagttcagcgtgggcacgaagtgaccgccatcgtccgtcatccagaccgagttaaaatggatgtttcaattttacaaaaagatttatttgatttgactacaactgatttagaaaatttcgatgtagtagttgatgcatttagagcggccgaaggaaaagaagaacaatttttgacatcaattgagcacttagtaaaaattttgacaggaacgtcagttaaattatttgtagtgggtggggcaggaagcctatacgtcgatgatcatattacccatctttatgaaactccgacatttccagaagtgtttaagcccacttcaatcatgatgggaagaggactagaagttttagagaatcagaatggattgaattggacttatattagtccagcggctgattttaaagctgatggtcccaagaagggacattacgttttaggaaatgaaatgctaatgagtgatgctaacggtaaaagcgaaattagttatgcggattatgcgattgctatgttagatgaaattgaaactggagaacataactgtgaacatttaagtgtagtttggtaaaaaaagatggaatcatgcccgattttaaacgaggtatgattccatctttttaattgttttctgaaattttaaatctttttgctaacatcgtattcgatgctgttttcagttttttggggatgacgatccttaacgtagaaaatagcgtactcctcatttttactaggattattaacaattactagatcatcgtcttgacgttgcttttgtttgtatagatgtcccttacgaacagcttcattataatcatggaagttaccaattgaatctccgggattaaataaaatggtttcactcattaagtccacctccttgttgtgctaccttaactatagcggatgttaacgctatcaacaaccgaaatggactctaatttaaggatttaatatatccaaaatttcttttttatagtgaatgaaatcggcagttagctcaaaatcggcctgtttacgtttagcagacgtaattttaatttcatggctgatggtagctggtttaccactcaggatataaatacgatcagataaagtaatggcttcatcaacgctatgggtaattagtaaggttgaattctgcatttgacgactaatatcggtgtaccactgataaattccacgtttggttaattcatctagagcactaaaaggttcgtctaaaagggttaagtccttagttgaaaggaaagttcttagcaaggctgcacgttgtttcattccaccagaaagttcatgggggtatttattttcataacccgttaagccaaagaattcaaaaagtggttcggcacgggcaatggctgcgctttttttaaaccctttgactaaatcaggcaagattacattattcataattgttcgaaaggggaggagcaagtctttttgcagcatgtagcctaggtgcccagcttgtccggtaatatcttcatcgttaaagacgatattgccagacttgggttgattaataccagctatgatgttaaatagggtggttttaccaatcccactgaccccgagaattgatacaatttcgtttggttttactgataaagaaacatcatggagaatttccttgtcaccgaaactttggttaatatgttgtacaagtaattctgtcattgtaattattcctcgataagttactgttttggtaagtattgattagtgaagccttgatttttagcgagtttttgttcaacaagtttatgatcattaagccacttgtaaaagttattccagcgcatagcgtcaatttttccaaattggccgtctttagttaagtagtatttagataagtaattttgactcttgtaaattaacttctgattactcttaagttctggaacggccttcattaataaatcagcagaagctttaggatttttagcggcatattgataaccttcggtggctgcagccatgaatgctttagcagcctttggattttgcttcaagaaactattgttcccaataatgagcggggtgtagtaatcaaacacaggattaatagatctaaaactaaagtaattaactggatagtttttaatttcggcgttaatacctgcccagccgtagaaaatccagattgcatcaacagccttggatttgagaccagcgacttcatcagtaatattgttagggaccgtttttaccttagaaaaatcaccaccatcatctttaaccacttgtttgatggttgctagttctgtaggagtattccaggttgcatagcgatagccttgcatttttttagggctagtgattccatcagccttacgcgacataattcctgaagtattatgttgaagaattgctcccatggcagtgaggggaaggggattctttttgccaattgcactagctaaagaatcttgaccagaaatcccaatttgagctttgccactagctacgatttgttcggcactatctttagaaggctgaacaaactttacttttagatgatgttttttgaagtagcctttttcttgggcaacatagaggcctgtatggttagtattgggcgtccaatctaaggcaaccgtaatggtttgagttttagccgctgaatttgattttccacaggcagtgagtaatagcgtaaaaataggtaaaaggacgattagactaaaaaattttttatgcttgagcatgattagttctcctccatggggtaataagatactgaatccagttaacaagtaaaattaaggccaaacttaaaattgaaattaaaaagattaccgcaaacattttgtcgtaagcataggccttcatgacacgtgtcatgtaaacccctaaaccattgaaaccgccgacccattctgaaactacggcgcctactaatgaatatgaaacggaaatttttaagctagcaaaaaatgaatcaattgcatcgggaaacttgatgtaaaaataaattttaggtgtattagcccctaaagtacgcatcaaggtaatgagatctttatcagttgaacgaaaagcatctagcatgccgactgcaatcggaaagaaagtagtagcaactactaaaactacttttggcaaaatgccataaccgaaccaaaggattaataaaggtgcaatcgcgacggtggggatggtttgagtaatcactagcaacgggtaaagcgctttataaatgggatgaaataaatccatgattaaggctaatccaactcctaaaagcactccaaagcatagtccccaaaatgcttcgatcagagtaactaatgagtttgaaaataaggcggaatagtcacttttaaaaacttctaaaaccgaaagtggggatggtaacaggaattcagggataatctggaagaaactaattgcttgccaaatggctaagattaataaaacagctacgataggtagaaaattaatgctggtatttgtcagttttttcatgaatgccaagaacctgtccttctggtttgtaattaatctttacataagacattacttgcggagcgccagcgtcagcagttattttagtaatattcttaacgatttccatcaattgatcatagtcgccctcaagggtggtttcaaaagcacctacttgataattaacaccggtagattttatatatttgatagcctggtcgacggcggcgactagcttcttttcgtcttccattataggaaggacttgaattgcgacacttgtgttcataaataaattcctccatttttaaaatttaggtacaaaaaaagccggcttaaaaagccagcttcaatgcatcttgtgttagaaaataatcattctaatattacaattgagtcttcctgcgctggcattatccatatcaggttcgagggtcaaaaaccatttagttttaatctcagccaggtaaagcccagcacccctgttacaaaatcagtatatcttaaattctaaataagtaaagagaaagttatttttaattttttaggataaatccttgcattttggtttagaccattttataattggactataccaaaaacgaaaaaggagatttgatcatgaaggttattattgttaaagataacgtagaaggcggaaaagaaggatacaaactatttgctgatgcaaagaaaaatggagcaacaacatttgggttagctactggtagtacaccgattaccacttatcaagaaattattaagagtgatctagattttacggactcaatctcaatcaatttagatgaatatgttggtttgccagaagatagtgaccaaagttatgattactttatgcacgaaaacctcttcaatgctaaaccattcaagcactcatacttaccaaatggtcgtgcagcagatcttgaagccgaagccaagcactatgaccaaattatcgaagataacccaattgatttacaaatccttggtatcggacgtaatggtcacattggttttaacgaaccaggtacacctgcagacagtacaactcacaaagtgtcactaactcaatcaacaattgatgctaacgctcgtttcttcgaacatgaagaagacgttccacgttatgctatttcaatgggacttgcttcaattatgaagagtaagcatattttgatcgaagcttacggcgaagacaaagctgatgcaatcaaaggtatgatcgaaggtcctgtcacaactgacttaccagctagtgttcttcaaaaccatgataacgttactgttattattgatgaagcagctgctagcaagctttcaaacaaataatttaaaatattcagcctaacataaagtctttgtgttaggcttttttttagtgcagtcaaaatgtaaaatttgttgatagttgaaaacgtttacgcaaagagatattatgaaatagtatgttggtgggatacttgaagctaaaacgtcacgcttaaaaaagtttttatgacattttaaaaccaaaatacattgaaatatcaataaataataatatttaaaaattctaacgatgaattttacaagcttacaaacggataatacgttacaataagctattattatgagagaaggagctatttaagttggaaaagacaattgcgatcaatgcgggaagctcaacccttaagtttaaattatttgaaatgccggaagaaagggttatttcatcaggaactgtcgatcggatcggtattccaggatcaaacttcacgattaagaccactgatggtaaaaaagttgaaattgaccaaccaattaaaaatcatgaagaagcagttaatttactcttaaaagagctattaaaattagatattattaaagattacagtgaaattaccggtgtaggacaccgagtagttgcgggtggagaaattttccaagattctgctttaattgatgacaaagtcttaaagcaaatcgaagacttaaaagaatatgcgcctttgcataatccagctaacgctacaggaatccgtgctttcaagaaggttttaccagatatcactagtgtggcagttttcgatacatctttccatgaaacgttacctgaaaaaaattatctttacagtattccttatgaatactatgaaaaatatggggctcgtaaatacggtgctcatggtactagtcatcaatatgtagcaggtcgtgcggctaagatgatgggcaagccattagaagaactaaaaattatcaccttacatttaggggctggtagttcaattacagctatcaaggacggaaaatcatttgatacatcaatgggctttacacctctagcagggattactatggcaacccgttctggtgatattgatgcctctttagtagtttacttaatgcaaaaacttaatattactaatccggaagacatcttaactattttgaataagaagtctggtttgctaggactatcaggaatgtcacctgatttgcgtgatataattgatgccgctgaaaaaggtgaacatcgtgcacaaatggccatcgatatttttgttaataatattgtgaaatacattggttcctatgcaactgaaatgggtggtttagatggaattgtatttacagcaggaattggtgaaaatagtgttccaatgcgtgaaaaaattacttctaaattaggaattttcaatgttaaacttgaccaagcgcttaatgaaaaacgtggagaacgtttcattagtgcggaagactcggctgtccaagtcatggtaattccaactgatgaagaattggcgattgctcgcgatgttgaaaagtttaagaaaatgggggactaactcatggatttatttgaaggtttgaagtcaaaaattaagggccaaaatagaacagttgtatttcccgaaggtgaagatgttcgagttttagctgccgctattcgattagctgatgatggcttagttcaatcaatcttactcggagtggaagctgatattaaagctactgctgaaaagcatggattaaaccttgaaaatgtgcaaattattggtccgagccaatatccggaagccgatcaaaaggaaatgattgataagttagttgaacgtcgtaagggtaaaaataccgaagaacaggttatcgaaatgctcaaagatgtaaattacttcggaactatgctagtttacttaggcaaggcggatgccatggtatctggagcagttcatgctactggtgatacagttcgccccgctcttcaaattatcaagactaaaccaggaatgcgtcgaattagtggagcatttattatgcaacgtgaaaatgaacgctatgtctttggggatgcagctattaatattgatcccgatgcagaaacattggctgaaattgcgattcaaagtgcagaaactgctcgcctatttgacattgaccctaaggttgcaatgttaagcttctcaactaaaggttcagcggctggaccaatggtagataaagttcgcgaagctactaaggttgcccaagaacgtgatccaaagaccccatatgatggtgaacttcagtttgatgcagcctttgttccagctgttggagcaagtaaggctccagattcagaaattgcaggacatgcgaatgtctttatcttccctgaacttcaatctggaaacattggttataagattgctcaacgtctaggcggttttgaagcaattggcccaatcttgcaaggacttaatgcaccggtttccgatttatctcgtggagctagtgaagaagatgtctataaagtagcaattattaccgcagctcaagtttagaaaataaaaataggaatcggaatttttccgactcctattttttttgtgcacattcagggcaatacccttcgacttcaatatgattggcaataatgtcgtatccagtttttttagcagcaatgcggtcgattttagctaaatcagatgcgtattcaggataatcaacatcaatgatttttccacagttaacgcaaattacgtggaaatgaggatggccatagtagtcgtaatgaattccatcttcactactagttaattcaatgactagaccttgatctaccagaagtttaagtgaattatatacagtggctaaacttaagctaggttctttggcgttgaccgctttaaaaatagtttccaccgttggatgatttcttttttcaatcaaatattccagtactaaccgacgttgaggagtaatccgtatatgattatcacgtaaatggtcaattgcttcatcaatagtctttttcatcatcctatttctcctatgtgttattaactaattgaaacactttttaagtttggtttcaatgtgccacaatcgaatttgaaaaaagttttcgttgcgcctttactttaccttttttaattaataaaattataattaagcttatttgaggagggcgtatacatgaataagattcgccaccagtttgatcaattggtgcaaggtgaatatcgtgaggccttcattctgattctaggaatgattgtgatgctgattggagagttttcaaccgcattggcagtcactaaaattgtggaagcatttggaaataatgaagttgtcgtacaactgacgaatattttacctttggcttggttagctttaatgtatccattgggcccagtttggttgcaaaaaaagtcagtcgttcagttgttaaagttatccttagctatttttatgattggttctttattagtagggatagcttttaatatgcctattttattactgggccggattattcaaaccacggggtgtggaattctattaccaatgcttccgagtttaattgcgacaattttaccagaaaaaaatgtgggtttaaccaaaatgagagatgttatgttaggagtagcgctagttttagccttatttctaaccggaatatcctttttattgggaaactggcaattaatcaatattttcttaattattttaagtctgatcatttaccacaatgcgtcaagtattaaaatcgatttagaaatcagtacatataatattgaacgggtaaacgtagttctttcgagtggttttatggtcctcattggttggatagttactttgggagatcaaatcacgagtagctggtttagctggggcttattggtgataggtattggtctaatcgcaacttatctgtggcgtgaattatctgtacccaatccgttgattgattttaaaggattattcaatgttcgatacttacgggctgtattactccaaggaatcggagatgcttccttagtagtattaatgattatcgggattttatatttgcgtcaaggattacattattcagtcattattattggattagccttgatgccatcgatcgtcgtgatgattttaatgcatcatgctaccaaacgatggtttaacaaattcgaatcggtcaataacgtcagaatggcgatgagcttaatgatggtgggatggggatgtctatccttattctcaacttacttaaacctaattttatttattgttttaactataataattgaagctgggcatggattgttaatgcaggtgggtcaagaactcagccaaaatcaaaaatcggcacgtttaaataacatggccgatatttttatggctcagttcaaattgatgtcctcaggcatgatattggcaattttgtcagttgttttgcagaatgtaaccaacagtcacactagtaacggattaccaggtaaattatcaaccctcgtgggataccgagctactttttcacttttctttgtgattacaattttaggttggattatcacgatgttggcaggcagaaacttaaacttaagcaaacatattgtaaaataattggggaattcaaatggattttaaagtagtttttagaaaaacaaaaacgtttttaagtgctttactgaagcggttcaacgattcggaagttgtaaataattcgattgttttagcgtattatttactactttcattttttccaatggtaatgttgatgggatcgttattaccattgtttgatatcaaagtgaacacggtgctagaatacattgaaacagtggtaccggtgacaatttacaacattaccgagcccattgttaaagattttctggggagtggaaatggcgagttactatcgttcagtttattgttgacaatctattcagctagccaagctgtggctgcttttcaacggacaattaatcgggcttatgatgtagctaaacatcaaaatcccattgttaatcggattgtcgcgtttgttttgaccgtaataatcattgctattatggggattttggtattcctctttagttttggacaaacgttgattagttatttaactccaattctgaatttaccaacgcatctgtttgatttgatcggtcagttgaaatggcctgtaactatcgtgggcttattcgttggattagcgttgttatactacttggtgcctaatgctaaaatcaaatttaagtacgttattccaggatcaattgccgcaaccattggaacaatgattatctcgcaatttttctcattctacttacgaatttttgcccgttcagtaaccagttataagactttgggaacctttattgcgattatgttctggctaaatttctcggcaatggtagttatgtttggtggagttttgaacgctacctggcaagagctacgtgaaggaaagattgtggaaacctccggcagtcttagaaaagtagctggtaagtataaaattaaaattaaaaaataaaagttatccaacagtggaattaaccgctgtggataacttttttatttttctgaataaaccacttcaaaaacttcggaaaccaccggcttatcctctgtaaattgagtatcatatttttgcatgagtttagtaaatttagctaacgaacgtgcccgccaatcttcaatcgataagtcgccttcaccctcattataggcgtgctcacctgagattcgaaggaaaggtactaattccgagacgaccgtctggatgattgcgattggtttcatgtcaccatttaaaaggatgaaataatcaccaacctgaggaacggcctcttgttctgctgaataataggcaagtggtttcgaggtagaacgtttcttaccacttaaaatcaaagcgttaagacggttaatttcgtctggttgatcttgaggaccaaaccaccgtgtctggtaagttttaccttcaattttattttttgtagtaaaatcatgccacattttttctgctggagttgtcataatatcattcctttcgaatgtaattaacttattttaacattgtgaaaacgtttacgcaaaaactgtggaattatgctattctaagtaaatttgacgtaagtcagctaaatcttgatctgaaaattcgagtgcttccttgaaataatgatcaaatgaaccaaaacgatcaagaattaaatcatgggtatgatcgagactggaagcagtcactgagaatacactattcattttttggataagtttatcaacatgtttaccagtaatttggcggcgaagctcatcgggatcttgattgctgtataccaaattagttagaaggtagtcttcacgaatagtttggtaggggacctgaagggctgaaagaatcagcataccggccatgcctgttcgatctttaccagctgcacagtggaaaagtaatgattctttttcgttggtattagctaataaatcgacaaacatctggtgaaaagcaatccgcgagtgttcactaaaggccattgttaggtatggatcatataaggactgttcataagcttgatattttaaatgtttattttggggtaaatcagatttttcgttatcttggataggataaactggataaaaacgatagatagtttgggctgggattttatcggaactccaggacgcttcagctggcgagcgaaggtcgatatcatatttgagtccataatcagccaatagggcctgagtgcgaggagttaaatgactcagctcacctgaacggagcaatttttgccatttaatagtctgattaaatttagtttgataaccacccagctcacgaaagtttactgcaccaggtacatctaaaatacgttccggtttcataagaaagaaaacctccctttattaatatcattaccattatagtctgatttaattccattcggaaaataaaaaatttaaaggtaagtaaaaagacgccaattaaggcgtctttttggggagtaggttgttgaaaactaaattctgtactttttggaggagtaatcagaataaaagtttaacgaatgaggaaatttctttcctcatccatgtaaatcatattaaagcataaatgtgaattttttgttaacgaagtgtattgaaagtaacaaactttgttaagttagttttaaaatatctttattctaagtaaattttacgcaaatcggtaatatcttgttcagttagctttagatactctcttaaataattatccatagatccagaaagtctacgaatttcatccatggcggaattataataagaaatatttacagattgaagagctttaacactttgaataaaggcggagtttttatttttgagtttaagatccatcacaacaccattttgataagctttagtagcgcgattagttaagagatagtcagcacgaatagtgtcttcatctacgtttaaagcacttaatagaaagattgctcccatgcctgttcggtctttaccagccgtgcaatggaaaagtagcgcagaatcatcagcactattagcaagcagcgcatcaaaaaacttgcgataagccttttgagaatgtctttggcgaattacatcccgataaacacggcgcatttcgactaatccactagtaggatcgctattcattttacgctgaagttcatcagtttgttttgtgctttgagtttcatcaactcgaaaaacaggagcaaaaacatattcagcgcctgaagggacacgatcaggaaatttacttttttcttcgggagaacggaaatcgacgtcaaatttaacgttgtaatcttctaaaaggcgtatatctgcatcagctagacctcctagttttccagaacgaatcaacttattccacttgatagttttaccatctaaatttgtatatccgcctagttcacgaaaattcaatccggatgaaataggtaaaagtcttggttttgtcatacaatctcctcgctttaaatattatttttaactcggttggccatgttgtcataaatccgtttacaatcgctgctattacctcgtaattcgtagtcatcaatcatttcaaagccgtaatcttgggcatagcgacgagctgttaaacagtattgttcgttaaagttacgatttccactaccaattacacctaagcaaaattttcggttatcatggtaagcaatatattcgccgagcgtattggtcatcagttctttaacgccattatcaataccatttccaccgtcaagataagtaggaacgaaggcaaaatatggttgagtttcatctgcaaaatcagtttgatcggtaacttctttgctaataattaaaggattactagtatcattttgatgcatcttttcagcataatctgtcagatcatctacaaatgactgggtattcccagcaactgatatatatataatgtaaatctgattttccatgttaaaaactccctgtctagaatttacttcaaaaaacattttacgcccctcttacctaaaatgataccacggtaaagttgcaaactcataatgttatgcaaaagtaagatgtgatatggaaacggtaacaaaaagtagtacaatgatagttaataatgtaaggggtgaagaatttggagccatatcttgtgtttatggatattgatggaaccttaatcgataaccatcagaacgttttaccggagacgaagagaaccatcgaaaaattacaacaacgcggtgtaattttctatattgcgacgggacggatgctttcgctagctgaactaatccgcaataaaatcaacgatcaagttgaaattatagcttcaaatggatctgtatatcaaaaaggacatcattttcataaagagcatttaggatggaatgcacttaaggaaatctataatataacgtcagaactaggtctttcgactaactttttcacaacagatatgacgtattacacacacgaaaagccgtggatgttgagtcgtttagctcgagttcgagttatggctgataagactggtaaccgacgttttgagaaagttagagacctggaacatttacaccaacttagtagtcaaattatcaatgggattaccattgataagaccaagtcggaacggctagatgaagcgcgtgaaaaaatggaggcaactgggttacttaaggtatcgtcgtcttcaccaaacaacttggaattaattcctaggcgaatttcaaaagcaactgctgtacgggcaattatggataaatatggcatcccgcttgaacgcacaattgcttttggaaatgacatgaatgacctagaaatgattaaagccgttggcacgggggttgcgatggggaatagtcctcaaatcctaaaaaacgaagccgatgcggttacggatagtaatgtggaaaacgggattgggaattttttggagtcatattttaaaatataaaaaaggaagtagcctttaaaggactacttccctttttatttaatcaaacaaagtctcggttatcgcgacaacaggagggacatcagcgagttcctcaggttttagtttgtgaactaagaaccaatcaatatgggcattttcattatcgagaacttcgaaatcataattttgaattcggacgtgttcaccaactttgatatctggtttgtgatcaataacgtagccaccaagagtaacgacgtcttcctcttcaaaatctggaacatcaatgccaaagtaacgttcaaaatcataaacggtcattttaccgctaactttataatgtccattttcttctttatgaatatagtcaccagaaacgtcatcgatttcatcattgatgttgccgaagacttcttcgtaaatatccttatcagtgataattccactggttccaccatattcatccacaacgactgaaattggtacctgtttttgaatcatttgttctaaaacatcttgtaaagcgagcgtttcaggaacggtaatgatattacggagtagtttgctaactttgatatcgccatcaacttggctttgacgaataatatcgtaattgtaaatatagccaagaattttatctttatcattattggctaccactgggaaacgactgaaacggctttgaagatactgacgtagagcttcatcaactttactattaatatctaagacaaccagttgcgtacggtcaatcatgatatctttagcgactttatcattaaaatcaaaagcccgttgcatgtaaacataatcatttttatccaattcaccgccactaacggcatttcgagaaagatttaaaatttctgcttgagagaatatttcgtcactttcatcggcgggttgcatccctagcaaacggacaattccattggccgaagcattaagcaaccaaacgaatggataaaaggtggtatggaaataatggaggggtgttacgacccacattaaaacttttagtggaatatcgatactaatattctttggaacaatttctgtaataaccacttctaagtaagttaacaatagaaccccaacaactgctcccacaatatgcagagaagctgagttaattaggtgagttgctccaaaaacttcaacaacaaaatattcaacggttgattcaccaatccaacctaagataataccacagatcgaagtacctacctgagtggtggataaatattcgttaagtttacgaaccatccgcatcgccagttgatatttcttctttttacgagcacttgttgtttctttttcagcctcttctaaggcactgagccgtgtttgcactaaagcaaattctgccgcaacaaaaaagtaagctaatataaaagtaattagcatcacaatcaggttagagactatctgaccgctatccaaaaataattccccatttcttttttctagttattgttacattatacaacgagaattttaaaaatagtatgaaaagtagctttctttttaatgttgtatagtgaagtttaatgttatcatgaagctataatttattatatagtggatggaggttcttgtactatgaaaaagattaacattggtggtatgcgcgtttctaacgttgctttaggtatcatgcgaatgaatgcgctatcagataaagacgcagcaacggccattgaggctgcttttgatataggaattaattatattgattcagctgatatttatggacatggtgaatccagcaaaaaattccgtgaaggactaaaactgtcgagtgtaagtcgtgaggatttgtacattcaatctaagggtggaattgaaaatagtaatagtggcgacatcccttatggcaatcgctataactttagtaaagagcacatcattggtgcggtcgacggcgaacttcagcgtttaggtgtggactatctagatgcctttttgcttcatcgacctgatccactaatggaaccagcacaaatcgcagaagcttttgatgaacttcaagctgctggtaaagtacgtcattttggggtttctaattttaatccaatgcaggttgaattagttcaaaagtacactaagcaaaaacttgaaattaatcagcttcaatttggaattatgcatacaggaatgattgattttggcatgcatactaacatgttcgacgaacgtagtattgatcatgatggccagattttggaatacgcaagattacacgatatgacaattcaagcttggtcaccttaccaatatggtttctttgatggtgtatttatcgataatcctaaattcccagaattaaataagaagatgaaacaaattgcagatatttatggtgtaactaagaatgccattgcaactgcgtggattttgagagatcctgcgcaattccaagtattattaggaaccatgaatcctcagcatattaaagaatcagctgctggtagtgatgtcgaacttactggtcaagaatggtatgacatttactatgctgctggaaatgacatgccttaaactaaaaatagtaacgtcccttactttatagtgaggtgcgttactattttttatttcttttgaatggctactcgtaaaattgttttacgctgggcttcttcaacacgccgaaaatcactcatatagatttcggtatgttctttttcgctgcgtacgtacccaccttcatcgataaattgctctaatttggcgaaactttcaggttcatcgtcgaacgcaccgacatgtaaaacctgcgctactaattgttctggttgatggtcgaaaaagacttggtcaaataaatcagcatcgattttagattttgcccgaactaacgcttctgcagcaattgcatcagtcacaaaatcaggttgtttaatactgattgtatatgcgaaatgttctttttgcatgactggcccatctaaatattgaggttgaattccccaatgtccttggagcggataaacggtgtataacttaaagttaggaatatcccaatcatttttttgactcatgcgaattgtataggataaaggataaagtgtttgaactcgcttctgaaaatcgggtaaattgggatcaccgttacctttgatactaaaataattttgagcagggatggttaaaatttgaggcttttttctaagtgaaaagccagcttcttctttacgccattcgattttttcgtccgtcataagaatgcctcgtgaattgcttagttgagtgttttgttagcgtcactgattttcattgtgatatttttagggtgatcttgaaccaccacaatggttcccttacctaagaaatctttttctccagtatatttgacggtatattctttagcgactgccccagaattttgaagtcccatgacgtatatttcttcatccgtagagtcatcactaaaaacgaatgcgatggcgggagtaacgacaatttggtccttcttcatttgacgtagggtatcccataaaccattgatgacttcgattggaaacattgcttttacttcttcagatacttttctttttttagttggatcaaacattaaattttcctccgtttttatgcatgtaaatagagtaccataaatgctaatttttgataaacaattctatgaatcgaggttaactagtttttaaaactagatgaagatgttataatgatagtaaataagtaaaggagcactagttatgagtgattataaagaataccaaagatggcttgaattagtacgattaattgaattaccccattgggatgatttgcctaattttgatctttatatggatcaagtagtggcattaatgaccgaatacacgggtcctttgggacttgaagcagtgactccggcgatggttaataattatgttaaaaataaggtaattgtcgctcccactaagaagaaatatcaagttatgcaaattgctgatatcttgttaattacacttttaaaacaatctttttccattcaagaaatccgttcaggaattgatcgggtgactgctagtgagtatcccaaacaagcctacgatcgcttcattgatttagttaataataaaatcaagcatatgggactatcacgtccagaccgtaatgccaacaatctaacagatcaacttttagaagcagcttccaacatgattattgatcaattagaaactaatcaattagttaaagtggttaaagattcgaaaaaacatcaaccgactaagattaaataaaaaaagaggatctacgatttatttgtcgtaggttctcttttttactattcaataatgtcaccgaaagtcccgtgaactagttgagctaaatcctccgcctttaattgaacagatcgaccaatttttcctgaagatacgatgattgtgccttgttctttggcaacatctgaaatgtaaataggaaagtgcttagtttcataaattccaataggagtattagccccatgttcgtaacccgtggttgcaattaaatcctttaatggaatcataccaacttttttattacccgaaattttagcaagttttttgtaacttagatgttcatcaactggtaaaactccaacaatggggccagttttatttccaattaatgctaaagttttataaatgaggtgatcatcaacaccgatgtaatcaacgtttaattgcttaacatcaccatcttgaaatgtcggaaaaataaattgcttgtattcaattttgtttttgtctaaaatctgttcaacaagggttttagagactttttctttcttctttttccccatgatctcaccacctatctttgtattttagcatagggaaaatcgttagttaataaaatcaaagcattcaagtttgctataatggtgaaagcaattaacaatgggagatagtttaatggaagatctgatctacaaaaaaatcattcacgaccttaaaaaaagaatctttaataatgaatttccaacgatgcgtttaccagatgaacgttcgttaactacggaatatgacgtgagtcgtagttccgtcaaaagagcattaagttccatggcacatgagggaatagtttttaaaaaacgaggttccggaacttttatcaatccactctatttgaaaagtcaatcctcttttaattatgaaggatctaatctaggtatcacagatagtttgaaatccaatggtaaaaagcagggaattaaagtgctagatttttcagtagttcctgctacggaaaatatgaagacagatttatttttaaatgaaggtgactttgtctatcaagttcgtcgcttacgtttgttagatgatgaaccaatcatgattgaaacgggctatattccaattaaaattgtgccggagttatccaaggccattgtggaaaaatcgatttttaattatttagaggacgctcaaggccaacacgtaacacgttcgtttatgtcgattcaagtagaaccctccaatgctgaagatcaaaaacttttaggattaaccgaaaatgaacccgtcggtgttatgtccggaattttctttatggatgatggtacgccgtttgaaatttcaaatatgcgaattcactacaaatatatgaattacagcacatttgtgtctgtcgattaagcaaagcatctaattttgattagatgcttttttacgttaaaatagccgttgaaaaggtgacttcgtatcatttttaaaattggaccgtatcaatttaaaaaatgattgaccttttttgagaaagcggttataataaattcataaattaaaaacaacctatttttcgctcacgaaaggaagagtacaatgacagattattcatcaaaagaatattttgacaagcttgaaaaattttggcgtgctgctaactatctttcagtaggacaattatatttaaaagacaatccgctattaaaacgcgacattaaaccagaagatgtaaaagttcatccaattggacactggggaacaattcctggacaaaactacatctatgctcatttaaaccgtgttatcaacaaatacggtgtaaacatgttttatgttgaaggaccaggtcatggtggccaagttatggtatctaactcataccttgatggttcatacactgaagcatacccagctatcactcaagatgaagaaggtatgaagaaactcttcaaacaattctcatggcccggtggggttgcttcacatgctgctcctgtaacaccaggttcaattcatgaaggtggggaacttggttactcattatcacatggtgttggtgctatcttagataacccagaccaaatcgctgctgttgtagttggtgatggtgaagctgaaacaggtcctttggctgcttcatggcaacataaccgtttcatcaaccctattactgatggtgctgttcttcctattttggatattaacggctataagttaagtaacccttcacttacatcacgtatgtcagatgaagaattaactgaattcttccatggtcaacattgggacccatactttgttgaaggtgatgattcagaagctatggatcctaagatggctgaagtaatggacaaggctatcgaaaagattcaagaaattcaaaagaatgctcgtgaaaaccacgatgaaactatgccatactggccagtaatcgtattccgttcacctaagggttggacaggtccaaagacttgggataacaaggttattgaaggtacattccgtgctcatcaaattccaatcccagtagaccaaaagaaccttgaacatgttgatgctttgattgactggatgaagtcatacaagccagaagaactatttgatgaaaatggtcgcgtattacctgaaattgcagaaattgcacctaagggtgaaaaacgtatggcatctaacccaatcacaaacggtggagttaacccaactgacttgaacttgccagattatcgtgactacgctgttgatacaacaaaacgtggacaaaacatcaaacaagatatgttggtatggtcagactacttacgcgatgttataactaagaacccaactaacttcagaatgtttggtcctgatgaaacaatgtcaaaccgtctatatggtttgtttgaagttacaaatcgtcaatttgttgctccaatcaagaaggactgggatgaagctcttgctcctgaaggtcgtattcttgatgctcaactttcagaacattcagctgaaggttggctagaaacatacacattgactggtcgtcatggtatctttactagttacgaagcattcctacgcgttgtggattcaatgattacacaacacttcaagtggttacgtaaggctgatgaattagattggcgtaatgattatccatcattgaaccttgtatctacatcaactagtttccaacaagatcacaatggttacactcaccaagatccaggtcttttgactcacttggctgaaaagaaaccagaattcattcgtgaatacttgccagctgatgcaaactcattgcttgctattagcccactagttatgaacgatcgtaacaagatcaacttgattattgcttctaagcaacctcgtcctcaattctactcaatggaagaagcagaagttcttgctaagaacggtttgggtattattgactgggcaagcacaactaatggtgaagaaccagacgttgtcttcgctgctgctggtacagaaccaaatatggaaagtttagctgcaatcaacatcttgcatgataacttcccagacttgaagattcgtttcatcaacgttgttgacttattgaaacttcaaagtcctaaggttaaccctaatggtctaagtgatgaagaatttgatcgttactttactaaggacaaaccggttatctttactttccatggtttcgaagacttaattcgttcaatcttctttgaccgtcataaccataacttacacgttcatggttaccgtgaagaaggggacattacaactccattcgacatgcgagttcttaacgaactagatcgtttccacttagcacaagacacaatcaattctattccagaatttgctgaaaagggtgcagacttctctcaacaaatggataacacacttgaacgtcattaccaatacattcgtgataacggtgatgatcttccagaagttactaactggacttggaaagatgttaactaattaaatcaaaacaaaaaagctgaaagctttgccaatagggcatagcttccagcttttttatttagttaaaaaattaaaataatcgggtataggagcagtgacttctattgtttctagattaaatggaagtggaaaacgaattttccaagaatgtaataacattggctgctgggtattatccagattatataaaggatcgccaataatagggtgacccagatatgaaaggtgaacgcgaatttggtgggttcgaccggtttctaaatctacttgtataagactgctattttcatactgagctagcacttgatagtgggtaatagcagataagggatttaaaccattaatttggcgtttacgtttatcatcggggtcaaaaccaattggaacattaatggtgcccttagattgctctaaatggccgctaacaacgcataaataggtgcgattaatgactttagtactaatttggcgattaagaataggcacgaccactggatttttagcaactaacaaagcgccactcgtgaactgatctaaccggtggacattatatgcttcgttttcggtgtccttgaagtaagcttgtaagaaattcatcatgcttcccaattcatgaggttgattagcatgagttttaacgcctgtaggtttattaacgaccattaagtccgaattttcataaagaataattggcacttgcgtaaaatctggatcaaacggcggaaggggggtgtcaaaatcagacgattcaaaattaagctcaattaagtcgccaccttggacgatggtgttgacgggaacatattttccattaaccaaaacgcgttcgttaatccgtaaaaagtggacaattttccgcgataataaccaagttctttgcagtaattctcgtaaactctgagggtggtataaactggaaagtctaatagcatggtgccattgcataatgaaactccttaacgaaataaaagaatcgactcaacaaaatgttcaatcgatcctttaagtatatggtattaatgataattatttcttttctggtttaacaatcaatacatcgcaaatcgcgttacggctaacgtaagttgcaacagaaccaaccattaaacgttccaaagcattaagtcctgttgaaccaatcataatcaattcgtttttatggtcagctggaaattcgcgtgcaataactggttttggattcccaaaacgaatgtgaacactaacatctttaactccagcgtcctcagcttttttcttgagttcttctaatcgatgttggacgtcctctgaaagtttatagattacatctccactaactgccccaccataagtatcactaaattggtttacttcaaggacatttaaaatatcgagatgagtgtcatttctttttgcaacttcaattgcgcgatctagaacaacatcagttgttttagacccatcaacaggtgctaagatatttttgtattgttgtagcatgttacccaccatccaatcatcttttcttatactaatgatatcattttcacaaaaaaatgtaagcctttttacatcgaatttaccggataaactaaaatatttctaattagacggcaaatgcgttaaaatgaacttgcgcaaattaaatggcgactacggccgccattaagcactctgcttctccatggagactgaatgcaagggctcgtggtaattactgcgagtcttttttatttccaccagagtttaatcaaagcctgggttccatcgtcgcctaatccctgttggttaactaaattatcataaagttgagtggccagacgcgtggcaggtaaatcaacttgcatttgcttagcttgatcaagtgcaatttttaaatctttaaggaaatgcttagcgaaaaatcccggagtatagtcattttttaaaattcgtggaacgtagttttccatactccaatttgatgcaccgccattggataaagtttcgagaactgtctttaagtcaagccgggcagctttagcgtataccaacatttcagttaagccagtcatggtcccggcaatcatgatttgattagccatcttagcattttgaccggcgccataagtaccaaaatagttagttgcatgtccaatttgaccaaagattggtttcatggtttcgaatgctgtctggttaccaccgaccataattgttaaagtagcattttgggcgccaatgtcgccaccagaaacaggagcatctaaggccataacagctagttcatcagcttttttaccaattttttcggctaatatgggcgaactagttgtcatatcaattaaaatttgtccggaagtaactgttgaaaaaatcccgtgatcaccaaagtaaacttcttccacatcttgtggaaaaccaaccatggtaataactgtttccacttgttgagttagctcggcgggagaagatgcccactgggctccttcttcaagtaaagggtctgctttagatttagtgcgagtaaaaacagcgacatcgtgaccattttttaataaattatggataatgccacttcccattactccggttccaataaagccaattttcataattaaaacctccgtatctgaatttttacttaattatagtgatattggagtgcgatacgcaatatatctatgtaaaaaagggcttttagatgttaaactcatagttagaaaacaaaaaaacgagggacaaaatgaaagtattagcaagtgaagttatccaaacattgaaagatgccagttttaaatcagaggaatttaaaattgggaaaacaactttaaaaaaagccgacggtacaggatttaaacctgctttagattttttgaaacaggccattcaagaaagcccaattgctgaagcaattattaatgttaataaaagtgtggttattaaaattcaatctaatattattaatttaccattgctttatcccggccctgtggagaaactaactgaagcagaaaaagaatatgatgttaatatttatgcagtaattgaagcagaaaaaattaattcgtctcatttacgaattgatcaaattgggacggcagaagatctaattagtactaatcctgatttacaagctaattttaaggattggatggcggaacaatttgatcgattagatcacccagataaggatcaaaaagataatgaggaataaaataggaggttcctatgaagagatttgaactaatagttggaacagcaatcgtaattgcattctctacattaatcctctccatctacactcatcatcagcaagtaattcagcaagaaaaagtggagttacaaaaatcagccaaaaagaaatcactacctaagagcacttctaaagatagtgggttagctggagatgaaattcaagctgcaaccacaaaatcaaaaaagggcgaaatgaacccaattaattggaaaaagtcttctgaaaacaaagcttatccagatttagataaatatccgaaagctttcttgaaggtatcgattgctaaacaacgagtgtatgtgatgaacggggaaaaagttttatatactatgtacgcgtcgactggatcacatgaaagtccaaccccaacagggacctataaaattcaggccgagcggggcgacttcttctataatccaacttcaaaggaaggcgctaagtactgggtatcctttaaagatcatggaatctatctgttccatactgttccaaccgataaaaacggaaaattccttgaggatgaagctgaacagttaggtaaagaagctcaatcacatggttgtgtgcgtttggcggttccagatgcaaaatggatttacgaaaaagtaccggagggtatgaaagttgaaatacattaggattgttcaaacatggttgttgaaaaagcgtcattttaaagacgaaattttatggggaattggcatcttagtggggttgttactaatatttaaaattttgggaagattaatattaggaaccaccttaattagttttagtgcactactatgggcgttactgctctatttagtggtcctttttgtaatccggtttgttgaaataaaactgcgaaggtagctacgatagttaagatttaattttgaggtctaatcgaaactaaatctttttttatatgattaaataaaaactctagcaaagttagattttggtagctaactttgctagagtttttaagctttttcctctgggcggttttttaatttgcgccaaataatttggaaaatagcaggaataataattaatagtaagaatatcaaagtaaaatactgcttgataaaaggggtttggccaaagaaataacccgaaaaacaacaaattccaacccataataagacaccgatgaaatttaatttattaaattgatgccaatccatttgggtggtcccggctacaattggaataaaaagaccgacaaagggaataaaacgagaaaatattagtgattttttagcattttcatcgaaaacttcctgagtttggttcattttttcggaatcactaatacgtttagcaattttgtttttagatttaatattcactccataacggtatttaacgatggcaccgctagtagctgcaatgataaaagtaatcgttaggataaaaatgttaagccgtgaattagctgcggaagcaatagttccagttaggaaaagtaccgattgacctggtaaaaatgaaaatacgataaaagctgtttccagaaaaatccagataaataaaatcaggtagacccagttatgaaggtgttcggttaaaggtgttatatatgttaaaggatgaatcacaaatccgagtatgagatcaaacatttatccacctcgctttcttttttctttattaatgataaagacttatttgctagattgcaattacagcgcctaatcggtgttgtatgttaatagatttcatgttacattagatacatgcgatgagtcgagataggtcagacaattctttgaattgtttcgctgcggcgactagtgaccatttcgccggcacacgttatctaccgtattgtagaagtgtgagtcataataggtgtgtgagccacctaacgactgcgttaacttcgttaatgaccggtaaaagaggatggacaattaattttgtccatcctctttttttgtctatttaattaagtaaagttggtcgtgaattaaatcaaatgattgataatgttggttaagttgctgggtattttcaggttcaattaatttagcggttttccaaaaaccagcactattggtggcgccatgaggttcgccaatgcaaattaaggtaggctgcttagttagcgagcgtagcttttcgagaatttgaacatcgattggaactccatctggagaccaggacatgattacaaaatcaacttgattaccatatttttcaattgctgatatagcatccagtttttcaacttcggtgacgagatgtttacctgtttcattttcttgaacccagtctaatgaatctgtggcataaacgttttgctgttttaagcgtaatccatgactgatgtaaccattaccagccataacttctagagtaggtctatcagccaaataatgagctaaatcgctaatgaacggggctgaaatatacgcccacataccgtaggtttcttcaaggtagtcgcgataggagcgcaaaagtttgtccaatttagggagctcggctgtcaatttttcccacaattggtcacctctaggatcacctaggggatattgatccttaatttgattaaaaatttgatcttgaatatcttcgggtaattctagtaccggtaattgctgaggtaagagcttttgttgaatcagacgattactttcaaggatctgattaattaaaaaggtaatcgtgctattttgtttaaaaagctcacgatagcgctcaaggcgagtaatatagttgttagttgttgaaacggggcgttccttttttaattgacgttttagtttttttaattttttaggattcattaagattcgtcctttgttttattccaattcaaagcgagttcttcttgttcaccggaagggcttagcgtacgacgttttttaccatggaaataaccatccattaattggaaaatttcatagcgatcgtcgctactaaggaccttatgatcaaagctcaattggcgacccgataggaataatttacttaaatcatattcattcaaggcagcacgaccacaaaggtaatccatactaacatcgaaatattctgcaagtttttttacttccaagtatgagggagttcgaataccacgttcccaatttccaatctggctggatgtattgggagtttcatctggaaaaagttcgttcaagcccttggcaagaacttctaaagtaatgtgttttccgtgccttaaagcacgtaagcgttctggaaacatgtgctatcctcctgtgacaatctgtctatactcattttaatacagaatgggggaatgcgacaaattaaagtaagtgtcacaaacgaggattgatttggcgcccggaaattatgatgggttgatacaacctttttgtaagaaataaaactaataaagacgcgtactaaaaataaaaatcaaacctaacggctgataaatttattatgaaattaaactattttttaaacgttaaggagaatttgttatccacaaatttgataatccgtatatactaaataagttagttctaggaggaaagtacgatgaagaaattatggaaatggttgttaataataatcggagtattattggttattgatattggagcaggaatgtatttcttccacgtagctgaagtacggggacccaaaagttttatttcaagtgaaaaaacacttaagaatgatccattaagaaaacaaaaagaatggtatcaaaacgtaaaaaaagagcaatggacaatgacttcggcaaccggaaatttgaagttaaaagcttattatatcccggctgaacatcagactaataagacggtagtaatggcacatggatttttacaaagtaaagaagctgaaggtgctccggcagctatgtttcatgaactagggtacaatgtattagctccagatgaccgtgctcatggagaaagcgaaggcaaactaatcggttacggttggaccgaccgacgcgattacattaagtggatgaacaaacttttgaagaccaagggtaaaaatcagcaaatcgtcatgtacggggttagcatgggaggcgctacgactatgatggttagtggagaagctgatgtacctaagcaagttaaagcttacgtcgaagattgtggttatactagcgttgatgatgaaattacatatcaagctaaatcaatgtatcatttaccaaagtatccgctagttccaacagttagtttgatttctaaaattcgtgcaggttacgactattctgaagccagcgccttgaagcaattggctaaaaataaaaaaccaatgttgtttattcatggttctaacgataccttcgttcctacttcaatgctagagcccctctacaatgcaaccaaaggaccaaaggaaaagtatgtggtcaaaggtgctaaacatgctgaagcaatgaatactaactataaaaaatataaacaaatagttgaaaaatttttagataaatatatggattaaaaaaactatggtagcaggttgcctctgacactaagcagtgcaaggtgacttgttatcatagtttttttatgcgtaaatactatcattttgcatataaacccactcgtcattggagacctgttcatatagcaaactggccagttcacgagaaatatttttctttcctaattgttcttgaataaagttatattcattttggaaggcgttaataaaaagttcttcctgaatttcgttagcacgagtgttattttgaaaacgacgatggcgttcacgatagtactcttcaatccagtggatttctgctcgattgtctgcgtttagatgttctctgagataagcaaaaatctgaggcgatatttcattttctacttgagctaattcgtctcgagcattattgaattttttggtaaccaccaaaggatctacccgtttaatgcgtcgtttgaaacgatggcttaatttaataaagtaaaaacgtgctcgatacatgaagtgctggataaacgattgatggagttggaaactttggaacaatgacattctttcgtaaaaagtttgttgtttaacgctaatttcaccattatccaccatctcttgaagtagtttctcttctaaattaaaacatttctgtaaaattttgtaagtagcgtttcgtttaggacgttgtaagatagactgttggcttcttaaagtagcaatcaccgcctgcgtttcgactggatcttcatcggcatcatggacgcgtttaatggcgtattcaatcattttttggcggtaggtgctaatatcttctaaactgtaggaataagttttggctggtaacatcaacggtaagataatacttggcacgagtaagctgagaatgatgacggttgccgcgatgaaaataatatcattgcggaatggaaaaatcttaccatgtaatacaattggaatagaaaaggccatcgatagggtaatagtcccatgaataccattaatagcaattaaaaaatgattaagtactttatcggctggccggatacggatgttggctagttttaaagtaacccataggtagcgaatgataatcatgacgatgtacaaaatgataccaaccaaaatgagataacctagcgaagaaacctgacggccttcattagtaatatcgtagatgacggttggaaatgaaactcctagaagaataaaaacgaaaccgttcattaagttagtaaaaatttcgtaggtggttttagacaccatttgagttttggttgaagtgagacgcaaggattgagcttgagtactttgaatcaatccagctgctaccacagccaaaattccggaagtatcaaacatttcagctagaaggtagatagcaaaaggcttaatgaagttgatggggacaataatgttggggttatcaatatcggtttcaattaagagtaattgtaagcgaacaaaaagccaaccgacaatccagccgacaattaagccaccaaagaagacatataggtaattaaaaatacttagaaccggagaaaaatgtcccgtatgaaaggcagttaaagctaaatcaaacattacgattccacttgcatcgttaaacaaagactcatttttgagactcagcatggcctcattaggaagatctagattttcggtcacggatgacactgcaaccgcatcggtaggggtaataatagcagctaaagcaaaggcaagggcaatcgggatatgaggtaataaagcatatcctaagtaaccaactagaataatcgtgacaacggctagtccaatggctagagaaaaggtattactcagagtacgtttaagtttgacaatgttagtgttcatcccgtcgtaaaacataagcggcgcaataattgctagcatgaaaacttcagggttaagattgaaatgattgaaattggggatgaaagaaagtgctaaccccatcataatttgaataatagcccgtggtaaaaatttgattttagtatctaatgcgtttgaaaaaacggtggcgatgattaaaatcaaaacgaaaaatacaatggacatgcacaacgactccttttttggtttctctaaatcaagcgtaccaaaaagccacaaaaaaatcgatttttgtggctttggtatagaagatattaatttttagcaaataatttagtgagataatccataaagcgcttgagataaaagtctgcatcgacattcaaagctacggaaacgttgggattttcttcgtttaaacggccggggtcaccaatggtacgaccccacatttcgtcagttgtatcaacgaacatgtttaaatccatagttttggaaaatgaagcatcaagggcaattcctaccgccaaaggatcatgcaaggcgcaaccgccaagatgaggactggtaattttgtaaacgtcgatatagtaatcaacgatatcagcaaatttactaccagcagtagtatctaggtcacgccaaagttgcgtttctttttttgttagtaacgttcttaaagtgacatctagaccaaccatggttaagttaacgtggctagtaaatacgtcattagcagcatgagggtcttggttgatgttagcttccgcaactggactaacatttccagggacagtaagagcaccacccataatagttacgttgccaattaaatcggcgacttctggatctttcttaaaggcaagtgcaagatttgttaggggaccggttggcactagaattaaatcggagttgtatttgtgagcagcttcgataataaaatcaaccccgggctgtgtttcaattgcccgagatggagcgggtagttcaacttcaccaataccattttttccatgaatttgagcactaataggcataacttcaaagctttcggtagtttgtgagtgttcctcaccaagaaagaccggaatatccgttctgcctagtaattcaagaattttcaagctgttagtaccagcgtcaggggttaacacattcccgtatgtcgaaacaataccaatcaaatcaacgtcaggtgctgccaaagcatatgcaatggccatagcatcatcaataccagtatctagatctaagatcatttttttagttgccaaaagaacccctccgaataaacaatttatgtattaaacttactttaatcatacgtaaacaaagcttaaaagacaatcccaagcattcttttttattgaagaagctggtaatatatttggtggattataaaaatgaaattgatttaataagggagcacaggcaatgacggaaatgtatgatattacgattattggtgggggtccagccggtttatttgctggattttatgctggaatgcgcactgccaaaacacaaattattgaaagccttccacaagctggtggacaagttgctgcactttatccagaaaaaatgatttacgatgtcggtggttatgctggaataaaagcagctaatttggctaaagaacttgaaaaacaaacgcgcttggtcggaactgaaattcgtcttaacgaaaccgttgttgatattcaagctcaagctgatttttaccatgttaaaactaatcggaatgaatacgatacccgagcaattcttttagcaactggtaatggagcatttaatccgcgaaagttagctgtggaagggttggaccatttagaagataaaaaaatctactatcatatgcccgatgttgaacattttgaaaatcaggatgttttagtggcaggtggtggtgactcggccattgatattgcgctcatgctggaaccaattgctaaaagtgtcagtttggtgcatcgtcgacagcaatttagggggatggaacggaatgtacaacgcctccaagaatcgacggttaaagtgatgacaccgtatttaattaatgatgttcgcgaggctgtcgaagaaatcgatgtcgatttgaaagaaattggtaccgaagccttaaaagctacccattttgataaactaattgttaactacggatttacctctagtaataaaattatcaaaggatgggaaatcgatttggcccaagaacatcgtatgtttgccgtcgatagcctgatgcatacaaatatgaaaaatatttatgcgattggtgatggggtagagtatcctggaaagttaagactaattgcaaccgcctttggtgaaggcccgattgcggtaaatcaaattatgaacgacttatatccaggcaaacgtggacctgttcatagtacatccatgtttgaaaaataatctgaatatataaaaatgcagtgaacttaaaaactaagttcactgcatttttgttaactgccattggcatctggatttgtaattttaattcggttttcactagttgatttgtggtttgcttcaggagcattagttttgtacaaatcttcaagtgatttatcttgattcttggagaacatagaagtcgattttaagcctaatttatcttctagcttggtggctttcgttaaaccatccgaataattgtagttagctgaattaacctttttaaagtccggattcttatagaaacggaggagattcttttcatttaacgaatctgacatcgctaattgttctttagcagctttacgatctttttcaactttctttttaaaagtggtgctaggatcggtaatctcattgccggaactgtcataaagtttaccaccgatagaactataggttggtgttacataatcgttatttctaaaagcaaccacttggtcatgttgcttagacaacaggtcagtaccaaattggatatagtttttggttgagattcctaataaatgcaagatcgttggtagaacatcaatttcaccaccatattgggattgaatgccaccatctttcatacctggaatgtgaatcattaatggggctcgttggagctgtgaattatcccaattattccaattttcagttggattagagccgaattctttaaaatgatcaggatcttgttcaaaagttttagctagtgctgtattagaggaattggaaattccataatgatcaccgtataaaacaatcatcgaatcatcatacaaaccggatttctttaagaaattaaagaattcttcaacagattgatctaagtaattagcagttttgaagtagttgtctacagttttatcgccagtactaggcgttttaaaagtactatcctcatcatctaaagtgtatgggatgtggttacttacagtgatgtatttagcataaaacggctgctgtaagtgttgaaggtacttaattgaatctttgaagagaagcttatcttttagaccataggtagtggatttatccccagaaacatcaaaatcactggcagagaagaagttctcataacccatatttttataagtgctattacgattccaaaatgaagcagtattaccgtggaaaaccgcagaagtgtagtttccatgttgttttaaaattgctggagcagcttggaaggtttgatcagatcctaactgagcgaacagtgaaccttgagctgtcccaaacgtgccagtttcaagcatattttcagcatcactagttttaccttgaccaacttgatggaaaaagttactaaatgagtaagttgatttactgtgataaatgctgtttaggaatggtgttactgtttggccttccactttatcatcgattaagaattgttggaaactttctaggtgaatgataataacattttttcccttagccttggcaaaagtaacatttgacggtttggcataatgatgcttaacatatttttcaattgaagttaattcgcttttcttagcttcagaacgcattttatggttacgttcaagttggacaccatcataagcagtaaaggcatcgagccccatgtatttaacaatataagaacgatcaaaagttctagtaattaactgcgggcgatccatttccgcgagcattagattaaatgcaaaaaataaaaagcccagtgaggtgatttgaaacccaaactttttaggtaaaggatgggggtccatttttattttcttcagaacgagtaataagaaaataacgatgatatctaaccagtagaaaatatcatgaacattagttaaggacattgaggtagcacttaagccttgattaaccttggaatagcccaacatagtattaacggtcataaagtcagaaaattctctaaagtagattacattgagatagagcatgacggtattggcgacatccaacaacatcgctacccaataaaaaatttttttcggtcgaatatataatgcaagtccaaagatgaggacggttgtagcaactggattaattaaaagaattatccattgaaagatactacctacacctagtgaaatatcagctagatatgcaaacagagtcttcgcccaaaataaaatagtaataaggataaagaatccgaatctagtatcaatttttgattttaaagatttcattttttaaagacctttcaaatagaacaagattaatgcataaatgcaattttaccatatttttttaaatgatttggttaactattgggtaagggggatgaataaaataaaattttaataattcttctgaattaagcagccattaataagttatctgggttaatatgatagatatattattaaaagatagtttcggaggcgaactagtatggaagctaaaatggttagaggtgctactggaccagtttatatggatgcgttagaaattcgtaaaaaagtgtttattgaagaacagggcattgatccggctcttgaatttgacgaaaatgaagatttctttacttactttgtgggctacgacgaagctaaaccgattgtgacggcgcgagcacgacgcgtcgatgatgatacttgggttgtacaaagagtggcaactaaaactggatatcgacgtcatgggttagcgcgtgatttgtttgaatttattgaagcccaagcagttaaaatgaacattaaaaaaattaaattacatgctcaagagagtgcggaaccattttactttgcgatgaattacgagcgcgttagtggtccagaaatggaagcgggcattgtacattattggatggaaaaggcgatttaatgtattggaataaaaaagtaatcttggtactaagtattgtgctaatggggcttgcagcggtcttctttgttaaaaatgatgcttttttatatcaaacaccggttggacgtattgaaagtgttaaaaaaattagtaaaactgtccaaattgataattttaaaaatcaagattacagtgtccgacaacagcttaaagtgaaaattttaaatggtaaagagcgtaatcgaattatcacggttaataatgaatatactaagtcgcaggcgacggatttaaaatatcgtaaaggccaaacggtcttattacatttaacccgacaccaccatcagattaagacagctacaattacagatttgaaacgcgacgtacctttgaccatcttaattgtgatggtaatcggcttattaataatgatgaagtcgaccggattaagggcactcttaagcttgattttaaacaccattttatttttcattgcagtggaaatcgatgttcagcaagaggcctcaggagttttttggatttttagcggaatcgcggccgttttttgtgcggtaacgttagtattagttttaggttggaacaaaaaaatgtgggtaagctttacaacgacgatgttaggaactttcatcgcagtcgctattagtttattagtctttagacttaccaataatgggggacttcattttgaaacgatggagtacgtaacacaaaatcccgaacctttatttctagctgaaacagtactaggatcattgggagcggtaatggatgaatcaactgacattattgttagtcttgccaagttacgaaaagaaaatccgctaatttcaatgaaacagctctggatttccggccgaaatatcgggaaaacaattatgggtcctctccttaacgttttattcatgatatttatggcagatacattttcaatgatggctctgtatcttagaaatggaaacggttggggctactcgtttgaaatgaacatgcaactgggatttgtacaaagcttaattagtggaattgggattgtattaactgttcctattgctagctggctggttggcattttctttaagaagggggcggtgcaacatgcatagcgcaactttaatattgatgctaattttagccctgttaatgattattgtgggcggtgcaacgggagtccgggcctttttaagtattatcttcaattttgccatattattcctaaatattgcattaattgcatggggatttccggcgctagtaataacaagtattagtggcttgattatccttgcaaccaccatttttatgggcagtgatgatgatcaaattacccaaaatgctttctacagttctgtcctagttttgatggtcctaatcgggttaattttattgctgcaaccccatttgttagttcatggatttgccaatgaaaataatgaagatttagaggggatgtcgcttttaattggtattaaattcagtgatgtgatgttagcgacaatgatggttagctcgcttggagcggtagctgaggcggcaattgctgtgtcggctgggttacaagaattaattgagactactccagacctagactacagtaaattgtttgtacatggatatgaaattggtaaagaaatcattggaacagctttaaataccttgttttttggcttctttggtagttttctaggattattcatttggtatgttaagttaaaatacagttttagtgagtttattaataacaaaatttttgctgcggaactttcaatgattctaattggatttattggagtaattagcacggtgccattgacagcgtgggtaatgcaattgcggcaacgcaaacaaaaagaactgtaacgacgaattaggctggtgaaagcctgagacagtagttaacagttctttttattaacgttattttttgaaaaaattgctccagttggcgatgagatagacaatcaaaattaaagcaaacgaaattagaatggtcagtgtccagctccaaggcgtattggccattggtaggctaacattttgtccataaaatccgaagacaatgttggggacagctaaaataatagataagatggttagaaatttcatcgtgttatttaagttgttatccaagatgtcagagtaggatttggagacttgttcgatgatatcagatgagagctgagccatttcttgactttgttcagactcaatcacaatttcttctaggcgcgtacgttgtcccttagttaattttaagtttggcatacgaagcatgctatttaataatgaagtatttgatttcaaagatgttaataaataaatcaaactagtctccaactgtagcatactttgaattccattgtgatttaaacgagttttaaatttattttgaatttcttgacggtcaaaattaattcgtgaaacagcgtcattaaagcgaatcgttagttcatagatcgtgttgaaaacggcattaaccataaacgagttattaaattcaaaattaggatcactatttttgcgtattagtgttttaacattgcgatctaaaagtttattcacatagtgagttgaatcatgcgtaaaaaccaccagcgcctttggtagaaacatgaacgccgcgggctcggtttgaacgccttcttttaaattagcactgagtgcatgaaaaatgatcaaaaaaatgttattgggttcatcaatttcggcccgtgctcgttcatttttatcaatagcatagctcaaagcttccgatgtagcatggtaagttttgactaaagtttgaagttcaagcgtgctaggattggaaacttgaatccaagaaaagtcgtcagattttttagtaacttttagcatagtaataatcctcactgtatttaatattattagtttaaccccaatgggatgaaaaaatatactaaatcgattaaaataaagtgtttagaagaaaaaaggagaaagaatttattgaatatattaacaaacctatatggaccctttttcgatattaataattgggaaaatgtgttgtcctccagttccgactggttagtaattttttcattggtaatgattgaatgtattttgtcggtcgacaatgcagtggttttagcaactcaaacacaagttttagaagataaaaaagaacgtgaaaaatccctattttatggtttatggggcgcctatattttcagatttattgtcatcggaatcggtacctttttaattaacttgtgggaaataaaggtaattggagctttatatttagcctacttggtatttaggttctttgacaagcaaaaaagaggacgcaagacgcgaaaactagttaaaaaagaagggcgactttccgtgttctggcgggtggtaatccaaattgaatttatggatattgttttctccgtcgattcagtcttggcttccttagcaatttcatctaatccggtaattgttttaattggtggtctgattgggattttagccatgcggggcattgctgaagtaatcatgaaaatgatgcaaaaaattccggaattagaaacgatggcatacgtattaattggaatcattgcgttaaaacttttattgtccattccaatgattgatattgaaattccatctattgtttttgcgggaattgtgatcttagcctttttaattacaattggaattcactatgccaaaagaccggcaaaaaaacaatgatataatttatggtaacaagttagtaaaaaggagacagaaatggccgttacaattaatcaagataacttaactgacgtgacacaatctggactaaccattgtggacttttgggctccttggtgtggtccttgtaaaatgatggaaccagccttagagagtttggaaaaaacttatggagatcaaatccagtttgccaaaatgaatgtggataacaatcaagcagtagcagaatcttttaaaattatgagcattccagcattggttttgtttaaagatggaaaagccattgaaaaagtgacggggtattatcctgaagcaaaattagccaaatacttagaaaagaagatatcagaaaatgaaccaaagtaaaacagcgattgtgattgatagttcagccaatatagctccggaaatcgtgcgtaagtatcattttacgatcgttaatcaaccggttatgtttggtaaacatgtttatcatgagaatatggacattgattcagatgaattttaccgaatgcttaagcttgaaaagtatcatcctacagcttctcaaattccaatgaaagaaatgcaggaagtctttagtaacttagctcaagcaggttatgaagcagccttgtgcattggtttatcgggaggcttgagtggttttatcaatagtgtatcagcatcggttccagcgattaaggatctccaggtttacccttatgattcgggttctattttagctggtgtagaaaaagttgccattctagcatctcatcttctagataatggagtagatatccacgaagttttacatcaaatgcgtaaatatcgtcgacagactcaagcttatattgcagtaaataacattaaagaacttcagaatatgggaaatatttctaaccgaacctcgttagtaggctcattttttggaatgcgccccattctaactattaatcaccaagggcgtttagagatggttggtaaagagcggcaaatgaagaatgcgatggaagcaatcgaagaaatttttgacaaacaattagttgaccataccaatttagtagtaactgtaattgatgccaatgatgtagatcgtagtatgcagtggcaaagcactttaaaggctaaataccctggaatgcaagttgagtcacaacagattggtccgtatgtaggtacttatactggtagtaaagcgattggactaatttggtcgccaaaattgtgatagtatagacgttagttattaagaaacgggtggatagaatgattacattaaagtcagaacgagaaattgaaggaatgagaaaggccggtgcagtacttgctggtatgcatatcggacttcgtgacattattaaaccaggtatctcaagctgggaaattgaaaagtttgcattaaaatacttagacaaaaacggtgctgttcctgaagaaaagggatttgaaggctacgaatatgcaacctgtgtaagtgttaataatgaagtttgtcatggctttccacgtaagggtttaatccttaaagaaggcgacttagttaaggttgatacggttgttagcgtggatggctacatgtctgactcatgctgggcttttgctgttggcgaagttagcgatgaagttaaaaaattaatggaagttactaaaaaggctttatatcttgggattgaccaagctgtagaaggcaaccgaattggtgatattggtcatgcaattcaatcatatgttgaagatgaaatgggttatggcgatgttcgtgaattcgtgggacatggtatccaacctacaatgcatgaagatccaatggtccctggatacggtgaagctggacatggtcctcgcttgaagaatggtatgacgattacaattgaacccatggttaatgttgggggatggcaatgtgatacttccgctccagatggttggactgttactacaatggatggtagtctctcttgtcaatacgaacacacactagtaatcacaccagacggtcctaagattttaacatctcaagatcctgttgaagatgctaagtatttgtagaagcaaaaaaggaagccttgacttttttagtcgagacttccttttgtttttgatgctaaaatggttacatcctaatcgttattttagtaattagcgatttcaatcagattaccatcgggatctttaattaagagtgattgaacatcgccatgagttccttggcgagttttaggatcgtcgataatttcgatgaaataacttttgagatggttaacaatttcttctattggatttttagcaacaacggaaagggcaatgctaccagtagtagcttgagctggagcaaattggggttgttggtctggagtaacgaagtaaattcgttgtttgccagcgcgaacccccgcgaatggagcatcgattagaatcggcatatcgaaaacttcatggtaaaagcgttcgctacgagcgatatcagatacagttagcgtaatatgatcaatttcacgaatattcattgtatgtaagtcctcctaataacgagattaagtatagcataggcaaattggattgacgatttgtataaattcatgctacggtggttattagttattttagaaaagttaaggtgaaaaaatgagtttattatcagttgagcatttgagccatggttttgcggacaaagagctctacgaagatgcaaattttgagttaaataaagaagaccacatgggaattgtgggacaaaatggtgctggtaaaagtacgttaatcaagattttaacgggggaaaccttgccagacaaaggtcgtattatttggcaaaataaagtgacgtatggttacttagaccagtatgcggacattcctaaggaagatacgttgtatgaatttttaacgaccgcatatgcagagttatttcgtcaacgtgatttgatggagaagtactatgcagattacgctgaaaatttagacgataagttgctagaaaaagctggaagaattcaggaaaatttagatgccaataatttctatgatattgatacggaaattaatcgagtaatgaccggtttgggtctcgacgatatcggcaaagatcatatcgtaagcgaaatgagtggtggacaacgttccaagattattttagctaagttacttcttcaaaatccagacgttttgatcttggatgaaccgacaaactacttagatactgctcatattagttggttggcagattacttgaatggctttgaaggagccttcatggtaatttcccatgactacgatttcttgcagaaggttactaactgtatttgtgatgtttcatttaataaaattactaagtatcgtggtgacttccaatcagcaatgcgtcaaaaagatgcgcgtaaggaagcccaattaaaagcgtttgagaaacaacaagtagtgattgaaaaagctgaaaacttcattcgtaagaataaagctggccaacgttcgacgatggctaaatcacgggagaagatgttaaatcggatggaaaaaatcgatccacctagtgaaaacttaaagggtcattttgattttccatatctcgatactggatctcaaaatgcagttgctgtgaataaattagcggtaggttacggcaagaagcaattgcttgaaccagtgacattttcaatgtcggcgggcgaaaaagtagctttctctgggtttaacggtgcgggtaagtcaaccttgattaagagtatcttaggagtaattccagctttaggtggagaagcccatttttcaccatctgccaaagttaattacttcacccaagaattaatatgggataatcctaaattgacaccattagaaaccattcaaaaccaataccctaagatgttgcctaaaaccattcggactaaattagctaagtgtggaatcaatgctgctgatactatgaagccgatgaaacaacttagtggtggagaacaaactaaggttaaattagctttaatggagttgattgattcaaatttcttaatcatggatgaaccaacaaaccatttggatgatgaaacgaagcgggccttaagtgaagcgttacaacgctttaaaggcaatttgatcgttgtatcccatgaggatagtttctattcccaatggattgataaagaaatcaacgtggaaaaattacgtctagatcgcgaataaccaagcaaaaaagcaaccccgtggggttgcttttttaatactcaatagcttaaaagtctgtggtatctggatcctgagctagaccagctacaccatggaaaccatcaattttcttgatgtcgtcatctgaaagttcaaaatcaaagatttcggtgttttgtttaatacggtcagcgtgaactgacttaggaagaggtaagaagccgtgttgtagtgaccaacgaagtacgacttgagcgacactcttattgtatttagcagcgatatctttaagttctggaatggtaaaaatcttaccagttcctagtggactatatgcttccgaaagaatgccatgttctttattgtaggccacaacttcatcttcagtatcactaggatttaggaagatttggttgactgctggagttactttggcagttttcaaaagttcatcaagatgatgagcacggaaattagatacaccaatcgcacgtactttaccagcatcgagggcttcttccatagcacgccatgagtcagcgttgcgctgttgccattcatcacggaattggactggatttggccagtgaattaggtataagtcgaggtaatcagtacctaatttagctaaactagtatctaacgcttttttagctgattcgtagccatggtcacgattccatagtttagacgtgatgaaaagttctttacgatcaattccactatctttaatggctttgccaacactttcttcgtttccataagctgcagctgtatcaatatgacggtagcccgcttctaaagcagccttaactgcattataagcttcatcaccatctttagattgccaagttccaaaaccaactacggggattttaactccgttgttaagggtataagtatctgttaaattattcatcaaaaagcctccttgattaccaataaactatattaataatagcgcttttacaggcggtaagctagtaaaaaggactaactaaaaattagttagtcctttttaaatatgacttatttagattacttattgaaagttccagcttcaacttcacgaagataatctgcaagatgtttgaagtaaactggtgcattatcaatcatgtgatgatggccaccattaggcgttgtaactaacttagcgttaggaataacttcagccatacgacgtgctgaatctagcggcatagtttcatgttcaccaaatgtcaataaggttgggacattgatatttttaatttggtcacgaacatcccattcgttaagttttccagtaacaacgaattcgttatcgccttggaaagcattataaaccggagtagccatagttggtactaaatgacggattgcaactggttgtttacgatcaacgtaaccagcattcaaaatgtcaactaatttttggtaacgttcgttgtcccagtcaccagatttttcgcagtcacgcatgaattgagcatcttcaggagcaagagcttcatcacggattgcatcttgatgttccaaatattcgtcaatgttatcgaccatggatgaaatgatagcacccttaagatgttgaccatatttaagagcatacatcattgttaatgcgccaccccatgattgaccgataaggtagaaatgatcaattccaagtttttgacgaacttcttcaacttcgtctaagaagtaatcatatgatagatatttttcggcgatttcaggatcggagtaatctggttgatcagaataccatgagcccagttggtcatagtaatgtacttggacattcaagccttgctttaaaagttcatcgtggaagttttcccaatattcatggtttccaccagggccaccgtgaagagctaatagatggattgaatcgtcgtcaccatcagtgtgagaccataaatggtatccattatctagtgttaaaattgttgttccttgtttcaaaacactcacctagtttcttaaatttaagcttataatatcagatttgaaggaaactgaccagaacccatattgatttaccattggtttaatcaataataaatttaaaaattaaattagtgtgctaactttatttttaaatgactttggtttaactgtaaagagtaaagcagttcttggttaccacgaatggtagtctcaaaatcagtagcatagataactagtcctaattgatgaccggctaataagcggtagaatgtaggttgaagttctaattttacatcatagaattgatggggtttaacttcatcaacacaataattattagtacgattttgtaagttgatatggcctttggaaatcattttccaaggagtgaccgcattttgaagcgtgaattcgcgtagatcatcagtccgccaatcaaaactaccactcaaagagcgtggttggagaatgctaggtgaaggattgagacgtttagcatctccaaaatcaactaattggaaactaagcatcccaaatggttggttaactgctacgttaacggaaacttcaggcgtaccatcgattaaccaatcttctttagtttgtgctgttttaaaaatcaagcgattattacgcatttgatttttaccattggtggcatgttctgtgtttagcaaatcagtatgccaatgctttaaatcatttttatacatttcgaaaaattctggatcaagggaatctcgaaatgaagctgcctcgtttttagtttcagaagcacgatccaccagcgttttagcttgtagtgtaaattctcgaatctcatcgtccgctgcttgccaatcttgataagtgttccaagtttcaggttcaacattatcttgaatgattacattaggaaggacttcgttagccccattttgaacgtcaaaaagtttgtaactaagccatagattcatcatatcggtgaaatcaattgaacgaaaagcattgatataaatgtgttgaccttggtgcagaataattttcttattgatcggtaagtcccgaacagcgttccaaagcttacctacatttcgtggtttaacgttccagtcattgaggccatgaaccattataatatcagctttaatatttttaacgttatttagataattcttactgtcccaatatttagaataattacctgagtcacggtcttgatctttttcaatacgtttcaaaatttgatcaaagtgggctttgatgcctaaataatccccagcatcatgtttacgacttaaaacttcagcggccaggacatccatatcttcgccttggaaagtatctggagcagcgaccaaaccaccgtctcggtaataatcgtaccagctagaaatggctgcttctgaaatgatggtctctaagccttccatcccagtggttgcagctgcagtggcgagggtgcctagataagagcggcccgtcatggcaattttatgattagaccaagaagctttaatctcaagattatcagttttgttagtaaaagcgcgtcgattgccggctaaccattcgatgattgctgtagttgaaatggtttcttcgacagagcccgtatcacgaagtccatcagaatctcgagtaccaatcccagcagcataaaccacggcgaagcctcgagataagaagtaattattcaaagtatagggctgttcgcgagcaaaagtttcacttgcttttgtagccattccagccactttacgttcagcaggaagtgtttggctgaatggttcggcagtgacgtcggatttagaaagtttttgaaccgttttttcagttaaaggaacatcaacgttgtgcgtaattgcttctccataactatcatttgtcccttgattataaggactcgctgtatataggactggagcttggtatccatgggcagtttgagcgggtcgtaaaatttcggctttaagtaaatcgcgctgtccatcgtgatcagtatcgagaggggcttccacataaattacttcacggatcaactgatgaggatcgaagactgcttgggcttttccattgaagaaaaggggcttagtggtcgttgggtaaaaactaacgaaataaccttgttgagttaggcggtctaaatagacttctccatttttggtgtgggtagttagtaagttataccaagcgtgtgccacatctgcactagtttcaaagtttttgagatcgagttctggaagttgaattttgctaatggtactaagtggatcttcaatttgataatcagtatcggcttcaaattgaagtaattggagttctaataagataaaaatttctaaagttagtggttgatcactttcgaaaaaagccgccatagtttgatcaggggttgcgagtaggttgtttaacttttgttggaaagttgcttcgctattacttacgaggcaagaacgttttagaaaatcttttaactgggctttcggatcagctaataaatcaccatcaataaaatgaatgttttttaattcttcaagttcggtagtgcgatccagtcgtattcgaccgaattgattgtttttcataacatggaacctccacaatatttatgtttcatattatacgcctaaagcaataaaacataattaggccttgaaatattttaaaaataagaaaaagttcgttttaaatttcttacaattaaaaaataagcttttagatcgtttgtaagcatctataaacgaacattaggtgttgaaaacaatgttaaagtatggaataatatggaagttgataaaaaatattttgatgggggaacgaaataatggatcaaaaattggatgataatgcttcatatggattattagaccgaacgtttcatcttacagaacaacatactacggttaaaagagaaattttggctggtttaacgacttttgtttcaatggcatacattttgtttgttaatcctacaatcctagggcaagccgggatggataaaggagcggttttcacagcaacggccatttcagcaattattggctgtgcgttgatggcctttcttgcaaattatccgattgcgattgctcctggattgggtgacaatgcctttttcactttctcagttgttttaggaatgggaattccatgggaaaaggcgatggccggagtatttattgcttctgttttattcacgattttatccttcctcaaagtacgtgaaattgtgattgactcgatctctaaagatctcaaattagctatggcggctgggattgggatcttcatcgcatttatcgggctgcaaggcggtggattagttacagcaagtaagacttcattagtggagatgggttccttgtccgttcccacaacgtggttaaccatttttggaatttttgtaatcgcgattttaatggcgaaaaaagtgccaggttcaatctttatcggtttagtttccactgcgattttagggttggtgacaggtttgattaaaatgccggagcatttgatttcccttgctcctagtatgaaaccaacctttggagtgggaattgctcatttgccttcaatcgctgaccctgagatgtgggccgtagttttaatcttattgctagttgcgttttttgataccgctggtactttaatcgggttagctcaacaagctggaattatgaaaaacaataaaatgccacgaattggacaggctctaatggcagattcaatttcaatgttagctggatcagtaatgggaactacacccacagcaacttatgtggaatcatctgccggtattgcagttggtggacgaacaggactgacttctctaaccgttggaatcttgtttgtatttagtatgtttttctcaccacttttaacagtcgttacaacgcaagtaactgcaccagctctaatcgtggttggggtattgatggcttctgcgcttcgtgaaattaattgggataaatttgaaattgctatgccagccttcctcaccattattggaatgccattgacttacaatatttcttacggaatggcatttggattcttaacttatccaatcttgatgaccgttgctggtcgtcgcaaggaagttaattacgttgtttggattttaatggtcgccttcgcactaatgctgtatgtgcttaacaaacttccaagttagtatgaaataaattaaaagagttgtgattaaagacatttgcctttatcacaactcttttttattgagccagtttactatgatgaatcccataactaaagtagataattaacccaattccaaaccagatggcagaaccaatccaggtttccaccgaaagtgtggtaattaaatagacacaagccaaggctgaaatgatgggaataaatggatatccaggtactttaaagcccgtattaggaatatcttggcgatgacgcagagggataattcccaacgataccaaagcgaatgctagtaaagtccccatattgactaagttagttaattgatctaaaggaacgaagcctcctagaaaggcgataaaaatggtaactaccaccatggcattgcgtggcgaatgatgttcccccactaagtttcctaagaccttaggcaacaaaccatcgcgtcctgtagcatataccagacgggaacttccataaatcatagaaatcatcatggtagtcattccggctaaagcgcccaatgaaagtaatccggccacccaattttgatggactaactgtaaagctagggcaacgggattggcaacattgagcttagtgtaaggaaccatccccgtaagaaccaaagaaacggccacatagaagatggtggcaataattaaagttccgataatgccaatgggcatcgttttcgaaggatttttaacttctgctgctgatgcagaaactgtatcaaaacctaaataagcaaaaaagaccgttgaggcaccggctaaagtaccgtgcacgccaaatggaaaataaggtttccaattagtaggtttaacataaaagattccgactaaaataaaaattagaatgatagcaattttaacaaagaccataaagttattgatccgaatggacgactggaagcctcgattaagtaaaaatccgattagcaagacgataataattgcgaataaattaatgtaagttccatgacttggattaaatgatccagaaatggcagtagggatgtgtatcccaaaaccacccaggagagaaccaaaataagcggaccatccagtagaaacggccgctactgctaagacatattccaaaattaaggcccaacctagcacccaaccgggaagttcaccgtaaatgatggttccatacgaataggcactcccagcaactggaatagaggctgcaaattcggcatagcacatgccggctagcgcgcatacaattgcagcaatcacgaaagaaattgtaatcgatggtccagccttcagtgctgcaacggtaccaggaaggatgaaaattccagttccaattactgcgccaattccaagcgccagtaagtcttttggaccaatggttttttcgaattttgagtcagtctttaagtaattatctaatgattcttttctcaaaattttatctattattttcataacacacttccttttctaatatctttctaataatactgaatcagtttcactacgtcaatcggatttcttttattaaaaatgtaaatttgattaaattaaaagaacgggactggtataatttatatggaagataatgtggaggttttaagatggcgttagaacttgatggtggagcagtagtgtatcagttacgtaacaatcagccgtattacttgcttttagaaagcgcaacgagtggtttttggggttttcccaagggtcatgtcgaagataaagagtctgtgattgaagcagctcaacgtgaaattcgtgaagagacaggtattatcacgaaagttaacgataattttttcgaggtattaagttatcaggttggtaaaaacctaaaaaaggttacattatttagtgctgaagttcctttagatacgacattgcggttacaagaagcggaaattagttcagctggatggttcgattacattacggcgcgtgaaaaattatcgtatttaaacttgaaacaagccttagataaggctgatcatttcattgcgagcataaaaccaagcgtataggtaaaataaaaattgtaaataagtacagaaaaagggctgcggcacatttaagtgtcacagccctcttatcctcatttgataaagcttattatagagtttaaattatgctagcttgctgaatgaattatcttctaggctttgaagattgcgaacagcctcttcaatggttacgccagttgcatgaaactctggttgggctttatcattagcgataaatacctgcttttctgtatcaagagcgatactataccatgctgagctatattttttgaattgcataatgataaacctcctatccttaaagtgtattttagaaagctttgaaaagcgctttcatttgttaggatactttaatttacaatatttttggaaaaaatgcaactattttgaattgaggagttaaaaatggataaagttattgtgattgctggaccaactggatcgggaaaaacgacgattgccgattacctttaccaaaaatatggagtgattaaggtaattacccacactacgagaccaaaaagaaaaaatgagcaatcaggaatcgattattactttgaaacagacgagacatttgatgataaccattacttagaacaggtgcagtattcttactatcgatatggttcttcgtatgagggccttcgacgtgcttggtcaaaaaatccaattgctagtattgtattagacacagctggagcagtaacttaccttaaagagttaggggcacaggtggaaatcttatttttgcgggtaaacgaagaaaaaactttgaaggatcgattgttaaaacgtggtgatagcttagaggcaatccaaaaaagaattgacagtcccgaatatcgacgcgacatgcagttgccagaagagcttcaagggcgggcgacggtcattaataacgatgattgggagcacaccaaacaaaaaattgatcaattttatcaaagagttaaagaagcaaccaaaaagataccaaatgaaggttaattatggtagggtaaaacgtaatgattactatttagaggtgcagatttttgaacaaaactagtaaagaaattgcggtaaaaattttaaaagctaataactataaattaactaaacaacgccagagcttactcaatattctagctaaccatgaggaccgctacatggaattgacggagttagatcagttaatgcgccaagagtatcctaaaatgagctacaatacaatttatcgaaacattaaggaattttctgaaattgggattgttgaagaaaatcaaaatgaaaatgatggtaaaaccgaagtaaagttagattgtaatgaacggcatactcatcatcaccattttatctgtaataactgtggtaaagtacgggaactccaaatgtgccctctaagcttctttagtgagcaattgccaggggctgagattacgggacatcattttgagttatatgggttatgcgcagattgtaagcaattaatgggtgaaaaatagataatttttttaagttattgcaaacttaatcaatatttgaaataaaagctaaatatttttgatatgctttttttaaagacggagggaaagagaaatggcatataggacaccaccttttttaacaccaattgcgattgttaccatggtcattgctttaagtgctacaaacgtaatcgttaataaggcgaccaacacttctgaaggagcgcccgtgcgttcttcaaaagtaatgaataatgaaagtagtagtaatttagacgataaaaattcatctgatgataaatcaagtaaaagttccatggatgaagatagtagctctaaagatgatgaaacaagtagttccaaagaagatgagacaatggattcaaatagcaccgaagactcacaaagtgatgcggaaagctcatcagatgctacggcaagcagcggtaaaactagcacaaatacaaatgaaaataataatgacgatactactaacaatgcatctagtgatgctgacacggatgcaaatcaagcatctagtgcagcccaaagttcggcaggtaccacaactcagaatgcccaagctgcatcaggtagctcggcgactagcacacaataggaggaattaacgtgatttcatttcttacattagcgagccattatatgggaatgatcaatgttaagagtaaactaaagaatcaagtttacacgatcatggcattcgtcggaaattggtatttactatatattggtattcgattcttacaaaatggacgctctcttagaggattattgctattagcaatctttttagtgttcttgtatttttcgattatgaacatttactacttcttcacgactaagaaggcaccttttgatatttctcctgtcttggagaaatatgtgggtggtgctccggaagaaattcgagaaaaagaagaatttagacggcgcttggcccaagtggaacgccaaagtcatcaagctagcagttcaccagcagggatgtttgaccaacggatgctactacctgcacaggtcgaatccacgggcgaacaaaagcgaaatattgaacaaattgcgatgttgatgaaaaatgctggaatcctttttgaggattacggtggacgaagtgatgaacagattaaggaacaattacaaccaggacaaacggaagcttacgctattggggacgaaggcattcaattcccatttgctgatataaaaataatcaatgggcagcctaccatttatgctggattaaatcagatggaagagttaccagttggcgtaattaccaaagttggggcagctagtttcgaagctgctaaacaagaaaatcacctttacttggcggatgtattattaagtggcggtgagaagaaaatgataggacgctcagggattatcactgaaaatgaaaatttttttataaaagtgaatattgcctataaacgccgtaatacctcgcttcatgaggtttaaagtataaaataattaaggactgttcaagcgatatgctttgacagtcctttttttgtcgcttatattttaaataggtatagaaaaaatgggagcttataggttgtataaggattcgtttaaataaccgatgggcgcagctggagggatttattatgtcaatgatcgaatttcataatgttgaaaagtactatgggaagttccacgccctgacagatatcaacttaacgattgaaaagggggagacagtagttttgattggaccatctggttctggtaaaagtactttaatccgaactattaacggattggaaagtattaatagcggacaactggtagttaacgggtttgatttggctagcaagaagaccaatatgaataagattcgtcgtgaagtaggcatggttttccaacattttaatttatacaacaataaaagtgtgcttgaaaatatcatgttagctcctcgtgtagttctaggacggaaggatgatgaaaataaaaaagttgccatggaattgttagacttagttgggctagcagataaggcagaaagtatgccatcgatgctttctggtggtcaaaagcaacgaattgcaatagctcggagtttggctatgcatccaaagtgtattttatttgatgaaccaacatcagctttggatccagaaatgattgacgatgttttaaatgtaatgaaaaagattgctaaagattcttcgatgaccatggttgtggtaacccatgaaatgggttttgctcgtgaagtaggggaccgcgttattttcatggacgaaggacaaattctagaagacgatcaagctaaggaattctttgatggacaaccaagtaacgaacgagcacgccaattcttaagtaaaattattaaacattaggaggggagaatatgcgaaaaatactgaaaagtgtcgccctcattttcaccctcatggcaagtttagtgttgttaagtagttgtggtgcgaagggtgaagtaaaaaatatagatgcttgggatcaagcccaaaagacggattccatcacttggggtgttaaagccgatactaaactgtttggtttgatggatgttaaagattcacaaattaagggatttgatatcgatattgccaaagcgttaaccaagcaaatgctcggaaaaaaggccaaagccaactttatccaagttacgagtcaaactcggatacctttactgaaaaacggtaatttagatgcaattattgctacgatgacaatcacgaaagaacgtgaaaaagttgtcgatttttcaaattcatactttgatgctggtcaatcgcttttagttaaaaaaggtagctccattaagagcgttaaagatttgaataagcccggaactaaagtgatcggggtggttggatctaattccgtcgagaatattaaaaagtttgctcctaaggcgcaggtaattcagcttcaagattatgctcaggctttgaccgctttaaaatctggtcaaggagcagcgttaacgactgataatggtattttatttgggatggcggtcgacaatcctaattatcaagttgttggaaaagcctttactaaagaaccttatgggattgcaattaataaaggacaaggtcagttgaaaaagcatctcaaccaagcattgaaagaattggaagaaagtggcgagtacaacaaactagtcgaaaaatggtttggaaatatcgctggatttgactacaaggaggttgaaagatgattaatataattgctagtcatggctcagaacttctaagtggactgggacaaaccgtcctttgtagtgtgattgcactattctttagtttgatcatcggatcaatgtttgcgatttttgaagttttaccaagtaaagtattacacaccatcggtagaatctatgtagaagtggtaagaaacattccgttattagtagtaacgatgtttttctacatcgtaattcctcaatatgtcgcttcgattaatggatttgttgctggaacgattggattaaccatttatacatcagcctttattgctgaaaccgtccgagcgggaattcaatcagttagtggtgggcaaatggaagcagctcgctcaaacggaatgacttattggcaagcaatgcgttacatcgtgttacctcaagcctttaagattgtgattccacctctaggtaaccaatttattaatttggttaagaattcatcagtacttgctttcgtagccggctttgacttgatgtatgtaggaaatgatattgcttctacttcctttgatacgattaattcgtatttagtagtgggagttatgtacttaattataaccatgccactcagttactatatgcgttatcttgaaaaacggacgaatcgaggtgctgcatgatgaaatcatttatggatgcttactcagcagtaaatttaatgtttttattaaagggactttggataaccgttgaagtttcggttatctcaattatcctaagttatattctaggtggaatattaggatttattcggtatatgagaataaagtatttttcagcgattgtgggtttcatcattgatttgatccgtaatttaccgttgattttaattttcttctttgtttatttcggtttacctaacttaggtttgagaattgaaattattccttcatctatcctagctctaaccgtttttgaatcggcgatgctagctgaaattattcgtggaggaatcgagtcaatttctaaagggcaaatggaaggtgctcgagctaacgggttaacgtactggcaagcaatgcgttacattattttgccgcaagctcaagtacgaatgattccggcattagttagtcaatttatttctttgattaaggatacttcattagcaacgattatcatgctgccagaattgatgtatcatgcgcaaatcatttatggacaaaatactaattacatcattccaatgttcgttgcattggctgtaatgtactttattgtttgttatgcgttatcactattttcgcgttacttggaaaaaagaattgcatcataaaattatacaaataggacgagtaacctcatctaaggttactcgtcctattttttaacattgtgtttactgatcattttgacggagccactcagttcgcttaagttttgtgaagtgttctttgcggatgtcgtctaagatcgggttatacatttcatcgatggttagttcaggtttgaaacctagtttcatttgaactcgcttagattggtgattgccatcatagtaaccacaccaaatgttagataatcctaacgtggtgaagccatccttgatgaccgctgctgcagcttctgggattagcccttgaccccagaatggctctccaatccaataaccaatttcggcatcattagctcccatgaaagatttcccaccacctttattaactatttctagcccgacgctaccaattgcctcgtcgggtttgtcccttagagttacggcataaatagtagcttgcatcaaatattgttcaatcagttgtcggctattagcgacgctggtatggacgggccagccagcaatgggtccaattttaggatttttagcatactgatagatgctgggagcatcatctggtgtaaaaggacgtaaataaagtctttcggttgaaatcggcattgtttttcttttcctcctataatttttatgtcttttggatgagaagatgaattactagattactattggctgttaaaaatcctcggcgatcttctaaagcaataattcttttttgattttttaagtatggtgcaagttgctggtcaaatgattctgcactggaagctttaatgggagttagttgatactcaccaggtgctattttttgagacgtaggtttagttgatactaagcaaatatcgtagtagtcaggagtaattacgtaatacaatttgcgcaatataaagtcaggattccaatttccatccataatttcggttattccaaaatcataatcgatgggtaagcgtttgaccgattgaagataaattggtgttgcaacttttagggtaggactcgctgaactttgatggatatttaactgatcatctaatattttctctagttgctccaaccgatgccgttcggtctgaatggctatttttttagctaacagtaaatccgttacggatggattggtttgcaagatttgctttatagatgccactgaaaaatccaattgtcttaaaaaaagaataaaggatagttggtatgcttgtgacataccgtattttcgatagccatttggtgcaatttcagcgggcttaaataagccctcatcttcataataacgaatagtatgatttgttgtttttaacaaacgtgctaaggttgagatagttactaatttttctggcatgccatcacctcattcatagagtataaaccttagggtaacccgaaggtcaagaggagtaaaaaaacagacgtccataattgagcgtctgtttttactttaattattgaattacataacgagcaaggcgttgataatctttttcttttaattctgcggtaatttcggttccttcttcggtataatcggtcttttttacatcagcgttgccgttaagaaaatcgaccacctgtccctcgttaaaaggaattaagaacttagcttcaacataatttttgaagacttgttttttaattaaagcggtaaccatttctagtgattgaagttgtttagctgaataagttaattcattgccatctagagtgggataactaactccagctaaatcggctttattaaaggcgtaaatcataggaatatcggttacaccgatttcgtttaaggtatcttctgtagtttgcatcatttcacgatagtgggggtcagaaatatcaacaatttgaactagtaaatcagctttagcagcttccgccaaagtcgaacggaaagctttgactaattgatgaggcaaatggctaacgaacccgacggtatcactcaaaattaattctttttgatcgggaaacgttaacttacgcacgctcgtatccaaagtagcgaagagcatgtctttttcaaaaacttgtttgtcttcattgcgaccatacatacgaactaacccgttcatggtagttgatttaccagtattggtgtaaccgaccaatgcaacacttggaatgcctttcttatcgcgttgcttacgttgaatgtcagaagaggttgtcatttcctttagttctttattaatatgattaattttattacggattgtccgtcggtttaactccagtttagtttcaccggaaccacggttggtgaagccgcctcctgtattaccagcagtttgctgatccaagcgttgggtggaactagtacgtaatcgaggtagttggtattgaagtttagctaattcaacttgaagtttagcttcacgagagtgagctcgattagcaaagatttctagaattaatcctgtacggtcaataaaatgtagattagtttctttttcgagattagttaactggctaggagaaagttcatcgtttaaaacaatggtatccacctctaaggccgttgcaatttgaaccagatcctcaactttacctttaccaaagtaagtggcggcattaggacgctctaatttttgagtcacttgatcaaccacgtccatattgttggccatggctagcgaccttaattcatccatggcgtaatccaggttcatattggggagttcgagtcccgctattagtattttctcattcataaaataaatggcctccaaagtttgaaaacgtttagataattatatcatggaagctgattagttacatgtaattaacgtttatgagataacatggtgctttggattagagaatagttaaaataattagagtttaatattgattttaatataattttaatatatactcattttcatagtaaaagataattggttgaaaatatagggagtgtgtgagatgaaactaaaaacagttgtaaagctcggctcagttgcattagcttcaacgtttgttttggcagcatgtggttcgagcaattcaaatagtaaaaaaacagcaaacattcaagagtctgctgaattagcaacaatggatcaatctaaggttacagatgtggttggttttacccaattaggtagtacagaagaaggactatatcgaattggtaagaacaataaagttgaaaatgcgattgctacaaaaactaaagtttcagatgatcacaaaacttacacatttactctacgaaaaggggttaagtggagtaatggcgatgaggtaactgcaaaagacttcgtatatggttggcaaagaacggtaaatccgaaaacagcttcccaatacgcatatatcttctcgggtgttaaaaatgccgataaaattgctagtggtaaagcgaactataaatcattgggaattaaggctgatggcaagtataagttgacggtgacccttgatcgtccgatttcttactttaaactcctgatgggaatgccaaccttcttccctcaaaatgagaaggccgttaaaaagtacggtgataagtatggtacttcggctaaaacaacagtttataacggtccatatcgaatggaaggttggacaggttctaacttaagctggaaactcgttaagaacaagacttactgggataagaaaaatgtcaagatggatactttgaactggaaagtggttaaagacactggaacggctctgaacatgtataatagtaataagcttgatcaaatgaccttatctagtgaacaggttaaacaatacaagaataataaagactacgttaagtacttaaatgcttcaactttctacattgaatataaccaaaagaaggacaagtactttaagaatgctaaaatccgtaaggctctttcgttagctattaatcgtcaacaatttgttgataagattaaaggtgatggatcaacggttgcaacgggagtaacgccggctaagttggctaaggatgaaaagaatggcaaggactttgcttctgaagtcgatgttaaatcagcttcggaatacaatttgaaagaagctaaaaagttgatggctgaaggtcttaaagaagaaggtatgcgttcattgaacttccaacttcttagtgatgatactaccgctgctaagcagtcaactgaattcttacaatcagcatttgaaaagatacctaatgtgaaagtttcgttaagtaacgtgccatttaagaaccgtttagcaaactcggtcgatggtaaattcgatgcagttattacagcatggagcgctgatttctcagatccaatctcattccttcaactatttacgtctgataactcacaaaataacggtaaatgggctaataaggaatacgataagttgattgaggctgcgaatactactgacgctggtaatactgaaaaacgttgggatgatatgttgaaggcggaacaaatcctattgaaggatcaagcagttgctccactttatcaacaaggacaatcaatgttgcgtaaaaccaaccttaagggtattgtgtataactcggctggattgaactttgattacaagcaggcatatatcaaataattaaaaatgggaacaaattacattgggtgagagtgatacattgctcttaccctttgtgcatattggaccagagattgtgagggagatttatggcaagatatcttgcaagacgtgttttttacttgctactgaccctgttcttgattgccagcattacgttctttttaatgaagttaatgcctggtacaccattgaataatcaagcaaagttaacaaaagcgcaaattcagattatttatgaacaatatgggcttaataagccggtgtggcaacaatacttgagctacatgattaatgcagtgcatggagatttcggaacttcattccagtttagtaatcaagaggtttcttacttaattggtagtcgaattggaccttctgcaaccatcgggattcagggaatgattctaggtgtggtttttggaaccattactggatcaattagtgccattcgcaaaaatacttgggttgatggaactgctaatattatttcgattctaggactttctgtaccaagttttgttttggcgattgtgctccaatactacatcggacttaaattacaatggcttccagtagccggatggggtgggtttgccagtacagtccttccatcaattgctttggcagctaatccctttgcaaccacttctcgttttgtgagaaccgaaatggtagatgtcttaggaagtgactatattgaacttgctagagcgaaagggatgagcaaaatgggaatagttttccatcatgctttgcgtaatagtttgattccattagttaccgtagtgggtccattagccgtcgctattatgactggttcaatggttgtggaaaatattttctcaattccaggaattggggaacaattcgttaagtcaatcttaactaacgactatccaactattatgggtgtaaccatgttgtactctggtctattatgtttagttctattattaacagatatcatctatggattgattgatccacgaattagaattactggaaagggggagtaatgtaatggaagaaaaagtgaacttacctaaagatgcctttcaacctgttagtaagggtgaacgtttagatgatgaaaaaattactgccccgtcgagaacgtttttgcaagacgcttggcggcgtttaaaggaaaataaagcagcctttatcagtatgtggattttaattatcgttgcgatttttgcattcacatcacccatcactgctccacatcccaataattctaatcccgattatgctaacttaccggctaaggttccaggagttaacattaacggctttaatggaacaattgtgcaaggtggggaacgaattgatgcttataaagctaataaagttccttcagataagtatttctaccttggaacagattatttaggacgtagcttagcacagcgaatcttacatgggacgatgatttctctattgattggggttttcgcaaccatcattgatttactaattggggtagggtacgggatcttctcggcctggaaaggcggaaaaatcgatattttcatgcagcgaattatcgaaattatgtcttccgttcctaatattgtaattatggttctgttactattggttttcaaaaatggtgggattttaccgattgtattagcgattgcgattaacgaatggactacaatggcacgactaactcgagcccagactctaagtttgaaaaatcaagagtacattctagctgcccagtcgctaggtgaatcgccatggaaaatctcggttaagcatttgctgcctaacctatccagtgtcatcattattcaaactatgtttaccattccaacggcaattttctttgaagccttcttgagttatatcggaattggtattcaagctcctactgcatcactaggaacgctgattaatgatggacaacgtaatttccagttcttaccattccaaatgtggtatccggcaattgttttggccattatcatgattgcatttaatattttagctgatggactccgtgacgcttttgatccacggacagcccgtagataggaggaaattgattaatgagttcaaataaaaaagtacttgaagtaaaaaatttagcgattgatttccatacctatgctggaacggttaaagcaatccgagacgttagttttgatttacatcagggagaaaccttggccatcgtgggagaatccggttctggaaaaacggtaactactaaaacgattatgggattgttagctaataatgcggaagttattgggggaaccgttgagctacacggcaaaaatattttaaagatgaatgatcgagaattgcaagacgttcgtggtaaaaatattgctgaaatcttccaagatccaatgacgtcattagatccaacgatgaagattggacgacaagttgccgagccattaatgattcaccagaagattagtaaagaaaaggcgcaaaaaagagcacttgaaatgctcaagttagtgggcatcaaagacgcagaaaaacgaattaatgattacccacatcaattctcaggggggatgcgccaacgaatcgtaattgcgattgcattaatttgtaatccagaaattttgattgctgacgaaccaactacggctttggatgtgactattcaagctcagatcttagatttaatgaaagaattgcaagccaagatttcgacttcaattatttttattacccatgatctaggcgtcgtagccagcatggccgatcgagtagcagtaatgtatgccggaaagattgtggaatatggatcagtggatgaaatcttttataatccacagcatccatatacttgggggctcttgaactccatgcccactttggatacagctaagggcgaattagaacctattcctggtactccgccagatttattggatccaccagttggggatgcttttgctgcccgtaatccttatgcgatgaagattgacgaggaacttgaaccaccattctttaaggttagcccatcgcattatgcagcaacttggttattacatccagatgcacccgcagtggaaccaccagcagaaattcaacggcgttggaagatttatcaagatacgtttcaaatcgattcagccgaccttcgcgttggggaataggaggaaaccatagtggacacaactaaaaagattttagaagtaaaacatttaaaacagtattttaatgtcggtaaaaaagacgaagtccatgccgttgatgacgtttcctttgatatctacgaaggtgaaacttttgggttagtgggcgagtctggttcaggaaaaacgactactggacgagctattattcgacttcaagatccaacttctggtaacgtgaattttgaaggaagagatattgcttcaattaagaagcggtcagacattatggaatttcgacgcgaaatgcagatgatcttccaagatccgtacgcttctttgaatccacgaatgaagatcaaagatattattgctgaagggattgatatccatcatttggctaaaaataaacaggatcgttctgaacaagtggaagaattgttggaaacggtggggctaaataaagaccattccagccgttatccaaatgaattttctggtgggcaacgtcagcggattgggattgcccgtgcgttagcggtgcaacctaaattcatcattgcggatgagccgatttctgctttggatgtttccatccaagctcaagtggttaatctaatgaaaaagttgcaagaagaaaagggactgacttacctatttattgcccatgatttatccatggtaaagtatatcagcgatcgaattggagttatgcattatggtaagatgctagaaattggtccagcagaggaagtttataatcatcctttgcatgcctacacagctagtttagtttcagctgttccagaacctgatccagagtttgaacgcaaccggcgtcaggttccatatgatgcagcccgcgaatttgatgataaagaacgacgcatggttgaaattacacctaatcattttgttaaagcagccgatgatgagattgaagaatatcgccaacgagcagaagcttacaaaataaagtgagtataaaaagaagcttgacgtttttacgtcaagcctcttttttatattttagtagttttaccaaagtatttaatttgtccactattttcagttaactgaagttccgtaacacttccgttacgaggactgtgagaaacatcgatttgatcgttaaacatggatgttaaaatgcgaatcaaggttccatgggagaccaccagcagatgatcgccatcttgagcttttttaaaggtataatccaatccttgctttagccgagtgacaatttcatcatagctttcagcatcatgaaaaggatcaacgtccttccagatatcaatagcgaccttgataccatgcatagccgtcatagcatttaaagttggttcaaccgtggagtgttgttgatacaatttaaactctgtttcgactgagttagctccttcgaagtaaccaaaaaattgttcgcgaaaagctgaaatcatctcaatttctttttcatttttaggatgttggttttgggcattgatgtaacgagcagtcttaatcgctcgggtagtatctgagcaatagatatttgcaaagttaacatcagtaagcaaatcaccagcatgcttagcatctgcaacgcctttttcagttagtggtgagtctgaccaaccttgaagatgacgataacgattaaataaagtttgtccatggcggacgaaataataattgacggttttcatgtaactcctatgctttcttaaatgcttttttaaagatattaaagaacagtgcataaacagcaattgtaataacgactacgattccccaagcaaagacgcctgaccaaatttgggcattgtacccaccttgaatggtgaagtaagcaccaatggcaaaggtgacaatcgcaaatgggtaagaagaacgagaaactttctttaattcattccgttctacccaagccataaatggtagtagcgctgagagtgcaataaaaataattggaataataatattaagtgcaagttctttatcgtataagttagtaccaagagttgcgtcagtaggacgaattcctaagaacgagaagacgatggtaataacgaaacaccaagctccaactaaccaagctacaatatcatttttgatgaaaacatattgtgatggaaaatccttactattttgccgaattcgcataaaggcaaagaaaacaaaactagtaacgaatggtgaaacaatcccattaatattaagtaaccagttaaacatatcattaatacttgggagccagttactaaggaaaagcactagtgaaacaattccagtagttaaccagtaaccattaattggtaatccatcactgtttaacttacctagtgatttaggaagatacttcatagctacatctgaaaggaagattcgggtacttgcatctaaaattacggccaattgagcaaacatataaactgcttgactgacagcgaagatgtacatgaatgtatttccaatcctgaattcatcacccaatgcttggaaagcataataagagccattcatcttcaaatcatatggtaaatggtgggcattaaagaacactgctaatgagaatgatccaaagacggttaagaaaacggtcatcaagaggagcatcatcatggctttaggaaaatcgcgttttccatctttcatttctttaacgtatggtgcggctagttcagcaccgttgatagcaaagattaacaaaccaaatgttgataagaaatgaccatcaatcttaggaataaatgcttttaaattaaatggttgagttgcaatatgacgaccgtgcattaaagccactacggtcataattacaaataggatggtcatcacgaacatcgcaccgccaccaatggtacttagaatttcaagtgaacggtttttgaagaagtgttggaaccaaataaatactaagaagacgacggcagtaaaaatagcaaacatgatggttggcatgtatttttgtaaatcaccattgcctttgactaaccaactaattgatacaactaccgaattagcaacatcgactacgtatggtaaaccagcaatccagtagaagaaagccacgatgtatccggctaaatctccattggtagaacgaatccaggatgctaaaccacccccatcttcgttgaaagttccacctaattgtccaaccatcatttcatagggccaaacaaaaagtaaaatcattaaaatccaagttgaaacaattgctaaaccttgattgtgaaaattataaattaaatcgtcgaacccaataaccgttacaaagtccattaaggctactacaggccaactaatataccttttttttgaatctaaaggtgaattatccattcttttatctctcctaaaatttgtttacaaaagctcttcgtctccatgattgttgtattcatcgagatgaaggccatcttcgtctaaagtaaaacgattaatactaccattttgaggaccccaagtaatatctagtgttggatcagcttttcctgccattgaacgaattgtagttccatgactgaccactagaatggtgtctccatcgttatgggtttccatcaattgggcaaagccacgattgagacgatcccagaattctgcatcattttccgcatcatggaaagggtcggctgctttcatcgcatcttttgaagcagcaatcgggttttcttccaaaaattcatggaaagttcgtttacctgaaactggcattaaagcttcgaaccaagcttgggcagaatcactaccttcgtaatagccgtagaattcttcgcggaattctggcatagtttcgattggtaattgttcatgcgcattttcagccataatggcgttggcggtattcattgcgcgggtagtatcggaggcataagccgcatcaaacgcaatgtttttcaaacgagctccggcccgatgtgcatcagcatagcccttttcggttaacggggagtctgaccaaccttgcattcggttatatttgttgaaaatagtttgtccatgacgaacaaaatatagttttaattttttcataaaaatcctttcctcacttattttttgtaaaacctaaatcattctatcatatatcccgtgtaccaaattagctaaatctttgtgaaaacgcataaaaaggagtaaaatttatgtctaacaaaactgagaggtgattcacattggcagagggaatttttgaatacgaaaatagacatttagatgaagttttagataaggtggatactgcaattgccaaagcagaaaatgacgccgataatgccgaaaaagatcgtagtgcgattgataagaatttttacaacgatgttcgaattaacacttccagttattcaggtatgatggatactgcaatttcaatccgtcaacaacagcaattattatctgaacgcgaaaatagttggcaacacgctaataaacgtttaaccacgtttaaagaaatgaaaaagcggccctattttgcacgaattgattttcacgaaaaaggtgaaaagaaggatgaaaccatctatattggtttagcttcattttcggacacggccgatcattttttgatttatgattggcgggctcccatttccagtgtttactatgacggaaaaatgggcgatgtggaatatgcaacgccagatggcacgcaaacggtagacttgaagttaaaacggcaatttactattgaagatggtaaattgatttcagtttacgatacggacgaaactatcggagatcaaatgctactaaacgcgttgggttctcaatccgatgttaagatgaaaagtattgtttcaaccatccaaagagaacagaataaaattattcgaaataccgcagccgatttactattcgttcaaggtgcagctggatcgggaaagaccgctgcgattttacagcgggtcgctttcttgctttaccgttaccgcggtaatttaaatgctggacaagtcatcatgttttcacctaatcaattgtttaatgattatgttgatcaagttttacccgaactgggcgaacaaaacatgattcagatgacctattatcaatttactagacgacggattccaaacatcgacgttgaaaacttgcaacaacgttttgataagaagctcacggatgcggaacgtaaaatcgaacaattcaaaggaagcttgcaatttttcaaagctactactaaatatgcgaaatatcttgggacggtaggtatgcgattccgcaatatcatgttccaatgtcaaccgtttgctactaaggaaaaaattaaagacatctactattcatttaatactacctataacttgggtaaccgaattgaaggaactcgggaagccttgatccgccaattgaaccaaaaagtaggtagtgaattgagaactaagtgggtggaagaagcggtccaaaaccttagccaagaagaattacacaacctatttaaaaacgagccccgtgaatttaaggataatgatgaagaatttaaattccttgctcgtcaaatcgtaatgaaagaacttaaaccggttcgaaatgcgattatgcgtaatcgcttcttaagtattaatgcccaatatgtccaaatgctacgttcgttccccaaatggtacgatttaaagaaagttggggtaacggaagcagaatgggataaccatgtggataaagtggtgaacgggcttaaggagcatcaattaaccatggtagatacaaccgcttatttatacttgtatgatttaattacgggtaaaaaaggtgatcgttccatgcgttatgcatttattgatgaaatccaagattataatgctttccaactagcttatattcggttcaattttcctcgagcaaaattcacacttttaggagatttaaatcaatcaatttacgccaatgaaactagtgatactttattagcagagttatcaacaatgtttgatccagaaaagacggaagtagttcaactatctaagtcatatcgttcaacacaacaaattacagactttactaaggaaatcttggttaaaggtgaagcaattgaatcctttaatcgtgcgggtgaattaccaaaggtttcaattaatagtagtcatcaaggaatggttgaggcggtgatcgaacagcttcatcgcgattgcctagatcatgagactagcgccattattgggcggagctatgctgaatgtgaacaaatcgcggatgaattaaaagcagctggcgagcaagtaacgctaatccgaactgaaaatcagcgtttggtggaaggtaccatcgttgttccatctttcttagccaagggattggaatttgattcagtaatcgtgtggaatacctcagcgaagatttatcaaactaatcgggatgaacagttattatatacaatttgttcacgggcaatgcatcgactcttaatcgttgctgagaatgatcttagtccgttaattactaagattcctgaaaatttatatattaaaaaagcttaataacttaaaatacaacacaaagagcttaaaataagatacttttttattaagctctttttattatattttgatatagttaactatgtaatcactttcaaaaaccaaaggagaaaaaataatgattcaaagtagttataccgggtcagattcaattctcgatagtttaatcaaccatgatgtaccatatatttttggtattcctggagccaaaattgatttgttatttgaacaactggaacattctaaccgagcaaaaaaacctaaattaattattacaagacatgaacaaaatgcggcatttatggcggctggtgttggaagaattaccggtaaaccgggagtagtgcttactacttcaggacctggcgtgggaaaccttgcaacgggattactaacggctacggctgaaggtgatccagtattagccattgggggccaagtaccacggaatgacttattgcgtttaactcatcaaagtatgcggaatgctgctttatttgaacccatcactaagtttagtgtggaagttcaagaaccagaaaacatttccgaagttttagcaaatgcttaccgggcggctgaatcatctaagcagggagctagttttgtcagttttccacaagatgtggttaatgcaccggttagttcgcgtccaatcaaacctttaagaaaaccgattctcggaccggcgagcccgattgaaattgaagagctagctaaagccattcgaaacggtcaacttcccgtattgctactcgggatgcgggcctcgtctcccgaggtgacaaaagccgtccgcgaattagtacggattgctaacttacctgttgtggaaaccttccaaggtgctggtattatttctcatgacttagaagatcatttttacggtcgagtggggttattccgcaaccaacctggggataagttattgaagcatagtgatttagtaatcacagtgggttacgatgccatcgaatatgaacctcgtaactggaacgcagaaggggatggcaagattattgtcattgacgattcgccgtctgaaattgatcataactttgaacctgaaaaggaattagttggggacatcgcgcaaacgattgatttgctaactccgcatcttaaaaattaccaagttggtgtggatggtgaacaatacttggaaacactccgtgagctgcaaaacaagcaagacttgccaccagtaccgaagcaagattccaaacgtattcatccattatctattatttccgcacttcaatatcgggttgatgatgaaatgactgtctcggttgatgtgggaagtttctacatttggatggctcgtcacttcagaagttatcagcctcgtcatttgctatttagtaatgggatgcaaaccttaggagtagcattgccatgggccatttcggccgctttgttacgtcctaatagtaagtcagtttcagtttcaggagatggtggattccttttctctgcgcaagaattagaaacggctgtccgtgaaaagttagatattgttcatattatttggaacgatggatactacgatatggttaagtttcaagaagaaattaagtatggacattctgcaggcgttgactttggccccgtagattttgttaaattggctgaaggatatggcgccaaaggattacgtgtggaaaaaccagaggacttgggtaaaattcttgacgaagcatttcaaacagaaggaccagtagtggtggatatcccagttgattattccgataacgttaagctagggcaatcacttcttcctgaccaattataggagggatttaaatggcaaaattatttcaacatgggacgctcgcaatgctagtagatggactttttggtgggacgcttgcggtttccgatttactgaagcacggtgactttggaatcggaactgctgaaggccttaatggcgaattaattattttagatggagtcccttaccaagcgctagcagacggtacaattagggttattggtgatgatgaactattaccgtttgctaacgttaattcagcggattttgaaggacgagcagtgttatctgacattgagatgaaagatgtggatgcgacacttgctaaagaattgtcatatcaaaatacatttgttgctattaaaattagtggaactttccgtacagttcaaactcgggtggtaaagaaacaagaacgtccttatccaacccttagtgaaacagcatctaaacaacaagtttttaatgctgaagatgttagaggaacagtagttggctactacaccccagatcttttccatggtgcgggagtagcggggatgcatcttcattttattgacgatcaacacgaattcggaggtcatttactagactttaaggcggatcaagttaaactttcttggcaactattagacggtttagacctcaatttaccaattcaagacgcagaatttatggcacatgaggctagcgacgcggaaaaaattcaacaatcaatttctgagtctgaataaacgaattatctatgctagaatagacgtaattttttgaagatgaggaattggaaatggaagcacaaggttattttgagtttaagcgggaagattggcaaaatttagccaaacgagccgaattaccactgacgacgcaacaattaacagatatcaaagctttaaatgatcaaatttcactcgaagacgtgcaagatgtttacgtgccgttagtacgattgctccaaaaaaagtatgcggattttgaaaaatggaatcgtgataaattagactttttacaattgccagttaaaaaaacgccttttattatcggtatttcagggagtgtggcggttggtaaaagtacaacagcacgtttactacaagaactcttgagtagctggtttacgagcttaaaaacccagttaataactaccgatggatttttataccctaccgcggaacttaagcgacggaatattttaaatcgcaaaggatttcccgaaagctatgatatgaaatccttaattaagtttttaagcgacgttaagagtggtaaaaaagaaattaaagtaccgaagtattctcatcaagtttacgatattgtggaaaatgagtttgatacgattgatcaaccagatattctgattgttgaggggatcaacgtgctacagttaccggctaatgaaaccatttatgtgagtgatttttttgattggtccatttatgtggatgcggatgcaaatttaattgagcaatggtttttagaacgcttcggggtattgcttgatacagcgttccatgatccaactaattattattacaaatacgctaaattaccacgttcggaagctttcgaaatggcacataaaatttggcgagatattaatttaaaaaacttggaagaatttatcttaccgacacggtttagagcggatattattctgcataagactacgggacatgtaatggataacattttagtacgagtttaaaaagattgcctagtgaggaatagctcactaggcaatcttttttattataggttatttagttactggtagctaaaagtaaattatccacatcattaagcttgatttgatggcgttctagtttagtaattaaatgctgctcgtgccattgcttgaagtaacgactaatggtttcaggtgtagtgccgaggagggtcgctaagtctttgtttttaaggggtaaacgaaccggattttgatttaaagcagatgcggtctcgactaagtagtcggccagacgacttgctacggattccgtattggatttagtcgtttgacgctctaattctaaaagtcggctacctaatgtgttcataacgttcattccaatctggggataacgcgtaagtaaattttgaaaatcagcgcgattaatagtacaaaccgttgagggagtgagcgtaatagccgtcgagttatgttcggtttgattaaagagcgcggcttcaccgttgatatcaccagcttggaggagatataagagttgttctttaccattttcggcagtacgaaagaccttaatttggccgttggcaatgattgagagtgcgtcaattcgatttccttcttgatataagaccgaattggcaggaagttgctgatgatgcacgatggattccactacagcagtttgttcgatatttaagtttttaaaaatcgggactagtggaacacagtgatgctgatgaagttgtttaggcaaaatatgacctcctgagttaggttacttttataatagctaaaattaaatttaaaaaaattgacctacgtcaatttcaactagtttgaaaccttatatgcttaatataacaaatcaaggaggttagttgaaatgacaaaaattattatgaaattggacacgttaacttgtcctagttgtatgaccaaaattgaaggggccttgaataagatggacggtgttaaaggggtaaaagtccttttcaatgctagtaaaatcaaggccgaagttgaacctgaaataaaaggtgaagccttgaaacaaacggtcgaaaatttaggatataccgttaaagacttaaaaacaaaggtgagtgaaggctaatgcgtgaagaaattgaagagctatatcaagctgaacaaaaacaaaatgaaattgaccatcatctccccacagctggggcaatgactaatcacatcttggcaaatctacgagtgatgtcgaccaaattaaaccaattagaatggtatataaaaggaaacaattattttgcggatcaacaatttttaagctcgatgcgccaaactgtggataactactttaaccaattaggacatcagttagtaaatgtaggagaaaagccttcatcaattactgaagaattttcagaatataaaatgttgacggaaaatgcgcgcaataaatatttaacggatcaagaaatgttagcaatgttagtcgatgatatccaaaccagcaagatgtttattagtcgagccattattttagcccaaaatgaaagtaaattttcattacaaaactttttgattgagttagatggtagtttcaatcaattttcagcagcaattcaagcgcggttaggtaaagaacccttggaaggcctggaagaagatgacgacgaagaggatgatgattaattttggctaagatacagcgatggtttacacaacatggcaatcccatgctggtagtagctggaacgctaaccgtgattggttggttaatgcaacacttagctgaccaggggttgattgccaatggggcttacggaatagcaactttggtagccggactacctatcatattcaaagccatttctgctttgcgagcacgagtgatgagcattgaattattagttagtattgccgtagttggggcagtagctatcttagaatttgaagaagcagcaatggtaacatttttgtttgcctttggaaacttcttggaacagcgaaccctacaaaaaacacaccaagcgattcaaaatttaacggaaatgcagccaacaacggccaccatggtggttgatggtcagtatcaagaagttgaaattgatgaggttgatgaaggggcagttctggttgtgcgagttggcgaccaggtcccagtagatggtgaaattattagcggtagtgctgaagttgatgaagcgttaatcaccggtgaatctaaattagtggataaaaccactggagaccaagcttatatgggttcgattgtggaaaacggccaaattttggtgcaagctcaaaaagttggcgaagatacaactttcggaaaaattatcgaattagtggaagaagcccaggataatcaagcaccgatgagtaagtttattgatcgttttgccaagtattacacacctttcgttttggtagtggcaatattaattttacttttcactaaaaacttacggttagccatcacgattttggttctagcttgtccaggggcactagtaattggagcaccagtttccaatgtagctggaatcgggcgtggagctaaggctggaatcttgattaagggtggagacgtaatcgatcaactagcccaagtggatacgattttgtttgataagacgggtacagttaccgaaggacggcccaccgttaaaagcattaaagaatatcaagaagatcactggctagcattagcagccgatttggaaaaacaaacgaatcatcccttagctcgttcgattgtggaatactacgaaaagcgtgggcaaaaaactacagccgattttaatttgcctataacaacgattaaagggattggaattaaaagtgaatatcaagggcaaacgatttggattggtagtcgtcgtgttttaacagaaaatcagattgagctaacgactcaacaagcccgcgatttacaggtcattgaaagtgatggacaatccgtagttttgatgactgttgaccaaaagctggtgttgatgatgggattagtcgatcaggttcgtaaaggtgtaaaagagacgtttgaaaaattaaaacagagtggaatcgacaagcagtggatgctaacgggtgataattcatttattgcggaaaagattgctaagactattgggattaatcaggttaaagcacaaatgctaccagaagaaaaagcactgtttttggagcagttacaaaatgatggtaggcacgttctatttgtcggagatggcatcaatgatagtccttcaattgccaaggcaaatgtcgggattgcgatgggaaatggaactgacgtagcaattgaaacttccgacgtggtattaattgattctgattttagtaatatcaaaaatgcccgtcgggtggcaaaggctactatgcgaaacacgatgcaaaacgtaggaattgccattggaaccgtggcgttgttattaatcggtgtggcttatggttgggtcaatatggccagtgggatgctttttcacgaaataagtatcttagtagttatttttaatgcaatgcggttgttaagaatgaaattttgaaaacgttaggtagtaagataatgacgcgattgatagccttttcatcgattgtgaggcaagcttaggggctatggtttttcccatttttactgtatgatagatgagtaagaataaaagaatgaggtgaaggacttggcgaacgcagatttatcaaattttgataaaatcattgttttggatttcggtagtcaatacaaccaattgattacacgtagaatccgtgaattcggtatttactctgagcttctttctcataagattactgctgaagaaatcaaaaagattaatcctaaaggaattatcttctctggtggacctaacagtgtttatgataaagatgcctttcgaattgacccagaaatttataagttaggtattccaattttaggtatttgttacggaatgcaattaatgacttataacttaggcggacgagttgaaccagctgataaccgtgaatacggtcatgctgatattgatgtgactgatgatcaagcggttatgtttaaagagcttcctgctaaacaaacagtttggatgagccatggtgatttggttcgtgaagttcctaaaggatttaagaccgttgcaactagcgcaaactgtccaattgcctcaatggctgatgatgctcgtaagttctacggggttcaattccatgctgaagtacgtaatactcaatatggtaacgaaattctccggcactttgcatttgacgtttgtgaagctaaagctaactggtccatgaacgactttatcgacatgcaagtacaacaaatccgtgaaactgtgggagaccgcaaagtattgcttggtctttctggtggtgtggattctagcgtggttggggtattgctcaataaagcaattggtgaccaattagtatgtatcttcgtagaccacggtttactccgtaagggcgaagcaaagcaagttatggatagtctagaaggtaagtttggtttgaacattatcaaagtggacgctcaagatcgcttcttgagtaagcttgctggtgtttcagaacctgaacaaaaacgtaagattattggtaacgagtttattcaagtatttaatgatgaagcacaaaaacttaaaggaattgacttcctagctcaaggtacgctttacactgatgtaatcgaaagtggaacagatactgctcaaacgattaagtcacatcataatgtgggtggacttccagaagacatgcactttgaattgattgaaccacttcgtactttatttaaagatgaagctcgtgatcttggtgaaaaattgggaatgccagaagatctcgtttggcgtcaaccattcccaggtcctggtttgggaattcgtgtaatcggtgaaatcactgaagacaaacttcaaatcgtacgtgacagtgacttgattcttcgcgaagaaatcaagaaggcaggtctcgaccgtgatatctggcaatacttcactgttttacctggaatccgtagtgttggtgttatgggtgacggccgcacttacgattacacagtaggtatccgtgccgttaactcaattgatggtatgactgctgactttgctcgtatcccatgggatgtcttgcaaaagatttcggtacgtatcgtaaatgaagtggaccatgttaaccgcatcgtctatgacattacttctaagccaccggcaactgtggaatgggaataaaagtaatataaatatgtttatgtaaatttaatctctaaattggattttttgaaatctaatttggagatttttttgttgggtcataacaaatctgtatacagtatctaaatttatttaaagcttacatagccctttaaaaaagaaagggagattggtattgttagtagttgaaggaacttaatataaatattcactttgggtttatttgataatttagatgaaaaaataacttaatgttttatcaattaagcaaaaagctaatgttagcttatccttggttttatttctagattagaatgtagtgattgtgatgacaaaacattttgaagttaagcaaaagtgtttaactattagagaaatagtatactcaaaattgaaggaaaaattaattaaattattctttatggaggattatatatatgcctcaggaaactatgaagcgtgcacttaggatttttatcagttcagcaatggaaaatggaaataattttgagagagaaagaatattagatttacgttttaaattaaagaatcgactcgatgaatataaaatttttgagccatggattttagaagaatctaatacatcttcaatcgaactagaagatttatataaatcagaacttattggttcggagttggttatagtgcttctagattcaagatattccattcctgagggggtacagaaagaaattatcactgctagaaataataatgtgaagcgaatgtactttatacttccaggaaataataatgaggaacaacatttaaaataaaatttattggtacaaggcgaaaccaaatttattaaagaactttccaaatcagatgattatgtaaaagaaattgaagatataattttaagagaacttgttaatgtatttagacatgctagtctgcaagaaagaaaaatgattagtagtgacgaagatgttaattctatagaagacggtcccaatatgtcgttgataccagagttgtcacagttcaataagaccacgtttaatcagattggttactcgaaacagatgtttagacaacttatttttcatgataactcagatgaaaaaatacttaatcctcagtcagctttagacgagggagtaagtcaattgatagatagaattgtatcaaataaaccactaaactttcattgggacgagaatatgcttgcgactgtgaaagaaattaactctgagccttccctttctcaattgtttttaagtgtattatcgcagagacttaaagcaattagacttttttttaatggaaaatataaagacactttagaagttttgaaaagtattttaaaaaatgaaaatttaactatttttccgaattggttcatacaagatatattaattgatcttagaaatttattttctcaaataaaagctcaacataatgaatctcattcaataaatccctaccaacagagacttaatgattttgcaactccttttttctatccaggaattgatcattcgcttaacgaggtgtattcttgggttcgtcaagagaataaccatactcttacagcctcacctactcaaacaagaatatatggtacaaacataaatatatactctgatgctttattagaagcaatagtatttgcagtttgtaatggatcaattgcacaaattcgtcaacttcctcaaaatttaaatatcatttctgaaatgcttcttcaaagatttaaagaccgtttatattttcgagatgtgattcaaaataagcttttaatggggaattcatttagtaaaatcaaaccttggattagaaaatatagttatttactcggacagttctccgacagagatgcacaaactattgttagtagagtgcattcttattcgacaggaaacgaaaaagtttcggttctttcgacaactatacgcatagttggagattacctgactgatgaacatttttgtagagaatggaaaatattatttaagtctattaatgattggattgacgctccagagcttatcgttagccctgcaaaagaaatattagggctacttcgttattgtttcaggattcctcaagacgatataataaatattttggaaaaaatatctaaaaacacaacaagatacaatgatgatctgattgacataatcgttggagctatagatcataaaaatgccacaccggttcagcgttgtagaattaacactattatcatgacaattatagctattaacgatagtgatagtttttctgataaagtaaaaaatgcaattcgattggttatttcatattggcctgatgatactactggactatgtgaacaattaaagaataaatattacaattttttcaaacaggatattttgccatatgttgggttagataaatctacctcaaatttacaaacttatttaaacaatgaaattaaggtaatggtatcccaaaataagaagcagagtggagaaataacatatggatttgcaaccaatccagcccaaaatattcttggtgtactttctagtaaaagtcgagttgaagaattgacattttttttctctgtatgaagcgattagtgaaactatattaaatccataccaacaagttgatgtaaagcaatcagcaacaaaatttttgatgtggttaattgtgcatgatcaaaaatcacaaaatgaaatagaggagttgtttaaaaaggttgatatcgctaatattacagcaatatcatctgatttttttgaaacgactactccaacccaatttatagaaactataaagacctttatatcaatttctttatcaaaaaaagataatggacagttacttttagcgctagctttaaccacatctcaaaaatacttgttatttttttctgattttttagttgagtttgtgccactggcactacagtttgattcgctatctagtgtgattccacaaatattacaatttttgattacctataattcaaataaaagtgaaaatgatttacttataaatatttcagaatgtttgctgattctttcagaagtttcaaattattctcaaatggctcttggacaacttcaaaaaatggtatcagacacaaatgatgttgtaaaacgtaatattgtcagtcaaataaagaaattagattgtgatacaaataatcaattacatgtaattaaggaacaattaattagtagttcaagttttgcagttcgagatcttgccaaacgagtactggaataagataaattttatttattttagattgattatagtgcttgtataattttttccgaaaaagaactagatataaacatcgaacgtggtttgattatttgttaaaaatatttattcatattatcgaaatttatatgtagtattagttaaatttttacagcactttttacttcaaaaattatatcagttatttagttaattctgtaagtttaactggaatggtggcgattaaacaattaaaataattaggtagatttaggaatttattatggaattatcagtacagatgagttgacacaagtgcgactcatctggtattacttgtttaaataagaacgcaacatagttaatttgaatgtaatcgttgatgaatttttaggaataaattcagtaaaaagtaaaaatactgatataaattagtcaaaagtagtttagtgacttaatgtggaaaatcctaaaaaagtggaatgagatatagttaaatggcattttggttatcaagacattttgcatctagtagccatgtaattaacagaagttccagccacggagaggaaagggttattcaaaactaataatagttgaaaatggggcctagttaggagtaggagttattattttgtccggagttaaccattggtagagggagtataatagctgctggagcagttgtggcaaaagatatagaaaaaaattgtttatatgcggaggttcctgcaaggaaaataaaggttttagaaacagtctagataaatggccttctctttatgaacgacttgtattgcggtgcttaactagtagttatctttttgctaagagttaaactgagtccctataaccccgggtttcagttattatttttttataagtttagattatgttatggtacaattctattgtttgataagtttgcatcctgttttaaacatttagtgtcagaaactaaacaaaatagattaccaaaataaaaaacttcagaaagaccaactttctgaagttttttatagttttaattaaattgcaaagtattagttctctgaaactaggaaatattggaaaatgtttatatcatcttcaaattttatttcatagaaggtgtggccgtcaatttgacgttcatcattcagatcaatataagtgcgatcgggatcagcaatgttacccatttcaactttgtggccattgattgtccatttatcattggaataatcattaattacttcatacttgatactaccatcctttttaaattgaatagtagcatggtctaagttatcgacagcattagcataagtagtaggatattctttggtaatataaaattttcgtccagctatctgtctagctggattttgataaagcgattttcaacaaaataaaatagctatcaatgtcaaaagactgataaggatattactcatttgaaacctcctgaattagtacctacaaatccgatgtattcacacctctaatgtgtagattagttagttacttttagcaatatttttttataaaataggtaaatttagctatgttgttttaccttcgatttcgttagttttaattttggaaggtggttactgcatggtaaaaagattccaatttattagaaaaaacagaaaaagaaaaaatttaacaatcgaacaattagcagaaaaggcggatgtttcgattgatttagttgccagattagagcgtggagaacgtgaagacgtatctatatcaaaactagaaagtatcttacacgctcttgatctagagctaggggatgtttttaagcacagtaaattagataagaaaagtgatgaatttgttagaaaatttttaaagttagatgccgaaacgcgtgaaaaatatacagatatatttcttagcattattgatttaaaaaatgaataaatgtaaatttatccattttttgtatcggcttacataaaaatgaagcattagttacttcgaatagatattttagatatttttctttgaattatcatcaatttttataatgaaattcttatttataaattaaattataagtcattgatttacgcgtgctagtatattataccgcaaatgttgtgtttgttaatacgctttcttcaaattttgaacgtatattcactaactcttattaaggatgcttaaataagacttacttatttttataaataagttatcgctaatttatcattttttttggaaaaaattacttttttaatttctacaaataaatctagagatgtggttgacacactaatttgtgagtttgtatactaatacgtgcatgttcggttgcttgagcaaaatatcctggggttaatgttttatgggatataatgctatacaaagttagagtgcaggatgaacagtaaagaattgggaagctttactgattttcattagcattctaattaaggacatgtagttggaatagcagggaagtgcttttttatttaactatttaaaaaagccaaagaaaaggagtaagaatataaggagtgtttatcgtgggaatacggatagatataacgggtaagaaatttggtaaattagtggctaagtatccatcagggaaagcaaaaaatgggaatactaaatggcactgtgtttgtgaatgtggacaagaaaaagatgttgaattacagcatcttaaatctggtggcacaaaaagttgtggaaattgttccagaatgaaatatgacttacaagggaaaagatttgctcgactaacagttttgggtagagcggataaagtcagttctaatggaaatatttattggttatgtcgttgtgtttgtggcaagatgattgaggccgacagttaccgtttacgaacagggaacgtaaaaagctgtgggtgcttacgtaaagaaaaggctgctcaaacaattcgaaagaatgcagcaacggcagaacaaattggaaacagtaacgctttcaaggatcggaatgggaatccggttcaagcagtcaacattggagctagaaatactagtggtgtaatcggtgtttcgtttgatcatccctcacaaaaatgggttgcacgaatgatgcataaaggagatttagttttaaatgctacatttctagatttcgaagaagctgtggaagcacgtcgaagagttgaacacaagtatcttaaaaatttaagtagaacaaattaatttaatgaaagacgtaacgctgataaaacaacgttacgtcttttttgatggaccaatttgacaaatctttcaattatttccattatagaagttatgtacttttaaaaagtaacattgagaggaagagttttaatgcaagaatcatcaacaaaaaaatccaatccgatggtagttgtggcgattgtggcactgatgtcttttatgggagttttaacggaaacttcaatgaacgttactttcccagctttgatgcgagaatttaaggtgtcattaagtacagtgcagtgggtaacggcaggctatttgttaatggctgcgttagtcatgttaacttcagcctacatggaaagaagatttaccaatcgacagttatttgtggcagcagccatcttatttggattgggagatgttatctgtggcgcagcgctgaatttttgggtgctcttggtaggccgtttaattcaagccggatgtgtggggttatgtactcctttaatggttaatataattttagaggttgtaccccaacacaagctaggaacttatattgggttagccaatttaattattttaattgcgcctgccatgggtccaacctttggaggggccgtggtcgcttttgcaagttggcgaatgattttctggggaacattaccgattgcattgattctaatggttttagggtctaaaaaaattaaacaatataccccaactcaaaaacagtatgcttttgattggatacgttttattcttttagggttggcactagtagccctaattgttggactcaataatttggggtcaggcgcttatatttcatttatcgtcttactattacttagtattggtttaacaacgctgtttgtaaaaaaatctaaaaatgctactaaagctttattttcactagacgtattcaaaaataaggcctttctatttagttttctaccatatataatgttgcaattcgctaacgtagggattaactttttgcttcctaactacgttcaagatgtattccaagcgacatccttaattggtggtttgattttgcttccagggagtctattaaatggatttggacaaccagtttatggttggatgttagataactttggcggaaaattaccattatatatgggtgatattttatttaccttagcgctagcatccttagccctttggggaccacatatgggagtattgggaattaccatagcatacttaatttttgccattggtcgttctatggcgtttggtaactccgttgcctatggtttaaaacatatcgaccaagaacttcaaaatgacgctaatgcgctatataacaccggtcaacaggtggcaggtgcgattggaacgactgttttagcgttaatgatgggttcagttcatcatccaggttacaccagagcccaaaatatcagtgcgggcagtggatgggcgtttattctacttgttattttaggattaattatcttgggcttctttcatcgattggtaaatttagataagcaaattaaacagacgaattaatcgtgaagttgtataattaaaattgtattataaaataaggagaaaactatggctaaaattacgcgtctttatgatttatttcaacccgaacactacgatatatttttagatatcagccgtgaaactaagcattttcgtggtaaaacgatcattcaggggatagcccagcagaccgaaattgcacttcaccaaaaggatttagaagttaaggtggtttatgttaatgatgagaaaacgccttttgaaattgattcagcaaatgaagtgattcgtctgcaactaagtcaagctggtaatgtaactttgactgttgaatacgaagctgaactaacggacagcatgatgggaatttatccatcatactatgaagtcgatggagttcaaaaacagttggttggtacccagtttgaaacaacttttgctcgacaagcctttcctgggattgatgaaccagaggctaaggcaacttttgatttagcaataaagtatgacgaacatgatggagaaaccattttaagtaatatgcctgaaattaaggtagtcgatggaattcattattttgatacgacggttaaaatgtcgacatatttaatcgcttttgcttttggagatcttcaaagtaaaatgacaaagacgactagcggcgtgcaagtcggagtctttgctactaaagctcatcaatctcaagaacttgattttgcacttgatattgctaaacgttcgatcgagttttatgaagaattttaccatacagcttatccgttgccccattcatggcaactagctctacctgatttttcagccggagcaatggaaaactgggggctagtaacatatcgtgaagcctatcttttattagatcctaagaacacggctctagaaactaaacaactagtggcaaccgtcatcgcgcacgagttagctcatcagtggtttggtgatttagttaccatgcaatggtgggatgatttatggttaaatgaaagtttcgccaatatgatggaatacgtagcaattgatgcgattgaacctgattggcatatttgggaaatgttccaaacgtccgatgttcctgcagccttacagcgagatgctactgatggtgtgcagtctgttcatgtgcagatccaaaacccagctgagatagacgctctatttgatggagccatcgtgtatgctaaaggagcacgtatgctagtaatggtgcgggccttgattggcgatgaggctttacgtaccggattgaagcagtactttaataatcatcagtatggaaatgcgaaaggggcggacttatgggctgctctaggagaagctgcggggattgatgtcggagcaatcatgcactcatggttagaacaaccgggttatcctgtagtgaatgttgaagtggtcgatggccaattaactattagtcaacaacaatttttcattggtgaaggacaaaatgcaagacggcaatggcaaatcccattaaaaggtaactatgaagtcgttcctcaaattttagatcaacctactttatcgttaggcgattatcaacagcttcgaaatgaaaatgggcaacctttccgactcaacgttggcaacgaatctcatttcatcgtccattatgctaaggatttattagcggatatcttgggagcattggaccaactaggagcaattgatcagctgcaaattctccaagacttaagattattagctgaaggaaatcaaatttcgtatgctgaaattgtaccgctactggaaaaatttgctgatagttcatcagcggtagttaacgatgttttatatcgcttggctggtgatttgaagaaatttgttcagcctgatagtgaagaagaggcgaaccttcaaaaacttttcaatcaacttagtgcaaaacaggtacaacgtttaggttggaaaccaagggccacggaaagtaatgatgatcagttaactcgaccttatgtattaggagccgcattgtatgcgaagaatcctgaagcaattttagcagcacatgaactttttgaacaaaatcaaaatcagttatcaaacttgtcagccgatattcgtagttatgttttgagtaacgaagtgaaaaactttaataacgaacgactatttaaccaattaatggaacagtaccgtcaatcgactgatccaagttataaagctgatttaagtagagcactcactgctactacggatgaaaagcaaatcaaagctattattgaaaaatttgaggatgctagcacgattaaacctcaagatttgcgagcttggttccgaggtctattagctaatgctaaagggcaacaattaacttgggattggattcgaaatgattggaaatggttggaagatactgtgggtggtgatatggaatttaataccttcatcacggtgattgctaatatatttagaacaccagcacggttggaggaattcaaagccttcttcgaacctaaattgcaaactccaggcttaacacgtgaaattacaatggacattaaagtcattgaaggtcgagtgaagttaatacaagccgaaaaagcagctgttaatacagccatcgaaaagataattgcataaaataaaaaattcaaccagcgtttaacgacgttggttgaatttttttgtttatttaatattttgaatttcgctagcgtggtcagataaatcaccaccggcattttgaacgactccattagcgtagacataatatgaaccatcatggtcggaagtaacgtggaaataaataggggaggatttaccaacggaactataagctactttccaacccttatcgccatatttggctttaactagattgatggccgcctcagaagtttggatagtttcatcagctaacggttgatgattattttgttgttcagcggctgttaaatctgcacgacttaggttgttagaattcgttttatttgagctattatggttactttcagacttactagaggaactaatagcactattggaagctttggaagtagaactacttgcgctagcaacgcttgatgaagtttgatcatccttagctgaagatgaactatcagaacttgccttcgaagatgatgaagcttcttgatctttcttagaactagcttttgagctagcctttttgctaaccttttctgttttagaagtagcatttgaagactgagaacctgaattttggtttccagatccgcagctagcaagcgtcagtggaaccaatgctaaaagtgcgattgaagcaatttttttcataataaaacactcccccataattatttgtaaatctcaataatcctgctttgattctaacacatatggtcattaccttaaaggaggttaaacactgtaaaaatggtgttgtaaacgtttaaaagtattgggaggaggtgtaaaattgattatagtgaaattaaacacataacacgaacggtggaggagtaaccatggaaaaagtaccatataatattggtctcgatattgggacgtcatcaattggttttgcagcaaccgataatcttaacaagcctattcgggcaaaaggtaaaaccgtcattggagtacgattatttgaagagggtaaaactgcagctgatcgacgtggatttagaacaacacgtcggcgattatcaagaagaaagtggcgtttaaggttacttgatgagattttcgataaagaaatggctaaggtagataataccttttttgctcgtttgaaagagtcgaatctttcacccaaagatgctaataagaaatatttaggatcattattatttccagaaaagaaggatttcaagttttatgaagattatccaacgatatatcatctacgttatgctctaatgcatgaaaaacgtcaatttgatattcgtgaagtttatttagcaatgcatcatattatcaaatattgtggtaattttttgaattcagccccaatgaattcttttaaaacacaagattttgattttgtggctaaatttgaaaaattaaacgaactctttgaaagtattgatgcggaacatgaaacgaaatttgatattgaaaatatttctaagtttagagatatcatgctaaatcaagatattcgtaagttagaccgaaaaaaacaagccgctaaaattttaatcctagatagtacagataagacggctaaaaagattaataataagtaaccttcactattaatctttgttcctaactcaaaatcttctgtaatcgtatccgtcggaaatcctccaactttatcaacaatttctcgcaagaaaactgcgtttgatcccgtaaacaaggcatgtccattagaaccatttaacacattgacgtcccgcgaaaagaaatcctgttcatttactacagcatcttgcaaaaagaggttaaattgaaaaatatctgcattgtaaaaactttgaggagtctgaacaaacccaattggcttagtatggtctggatcctcttccaattccgcaaaattttctgtaaaaaatgggacactactagttaaaaaattagaaaaaggcatcatatctgcatcaaaaatagcaaataacggcgcatctaactgttcaagcgcattattaatattccccgctttagcatgcttatttttttccatcgtcacatagttaacctgatattctttagctcgttcccgtacttctggacgatttccatcatctgcaattacgatgttaactttacttttatcaggataatccataaaagttgctgcattgactgtttttcttagcaacgaaacttcttcgttatgcgtaacaataattacgtcaattttaggaatcggctgttgcaaatcaaacttaggaatttctagtttttgggtcttatctgctcgaattaatctaaaaataatcaatacataggcagtaaaactagagaagatttcactccctaccagcaataaagcaaaaatcaaagtaaatatgtgtgcgtgccatgaaatggtaaaaaatacacgccaaaacaggtaaattactgatagaacaattgctaaaatataactaactttcttgatttttggcataattcacctcagtatcttttttaaaaataaagtctttttgaatttggtaactaatgataaataatgtgaagtcaaccatcattttggccaacatgggggcaatgctatttccattatgtggtaaccaattggtaactaagtccgttagataacctgaaaggatcatctacactataaataaagccccgtatttaatgaaagtttgccgcccacctccattaaaaacaacgcgatgattcagcgtataattaactaccgctgaaagtgctctagaaataactgttgctaggataatactatctaacacatggtttcccattagtaggataattccttcaaaaagcgcaatatcaacaataaaagaaataattccgctccctgcaaatttaaagaaacgggcatagattgcaagcgagtctcgaaccactcgaaaatgagatgacttattaccatccaaataaatggttggaatgggttgctcaatcacttttacatcatatttacgcgcctgaagcaacatatcaaattcgaactcaaaacggtctccaggaaattcaattaactgatctacatattggtgaggaataattcttagacctgtttgtgtatctgagatattctggtgagttaacaacttcactaatttacttgttaagacatttccgaattgacttcgtgcgggaatttcgttagtaaatttgcgaactccaataatcaagtctgtgggattttcttcgaacttctccatacatgagcttaaagctcccacggtatgttgtccgtctgaatccattgtcgcaatcccttcgatttctggaaaatagttgcggatataacggaaaccatttttcaacgccgcgccttttccttcattatgttgatgatgtaaaacatgaattcgctgatctccaatttcctcaagttctttaaaaacagcttggttcgtgaccgcactgccatcatcaaccaatactagcgcatcaaaattaatcacattatttaataattcatggaccaatttaattaacttttagtccggatttaaagctggaatcaaaattccatattttttcataatttcacctattatttaaactcaaaataaaaattttccaccctatatcatggtacactctatacaccttgaagaagtgcattaacactcaaatgtaatagaagtgtaaaataaatcgttttaccagtataaaacacaatccgtttgtacattatctttcaccctagtaataatttacgttgtaaataaccagcgaaaacccattatacttaacttgtttgactaatgcaataaactttgagacgtaaaaaagttttttattgaaattaattttaaacaaaacatatctaaactagaaaaatactatcaatgtctaagttatggtatcatcgtaaatgtaagcgcattaacaaacaaaaacggcggtgacttaaacaatggatttaacaattgtacgacatagtattagtagcgataacggtcgcggattaatttcgggggctggttctgatgttgatctttcagaagctggaatcgagttagcccaagaggctcaacgtgcttttgactggaatcaatttgatcaagttttctccagtcccatgcgtcgggctaaacaaacggccgaattactcttaggtgaccaagcttcagcgattaattttgatgaacctttaactgaaatgaattttggagactgggatggaactgccgaagacgcaatttttgaacaatatcctgaaattttcaatcaaatggggatgtttaatgagaagtattccgattatgcacccaattcagaaagttacgatgagctggttaaccgcgtaacaggctttttagatgaattgaagcaaaaatatccgactgcatcaatcctactcatttgtcacggaatgactacgcgagctctctttgctgccttactccacgtcagtcctgcccaatttggtaagattggcaacgttactttaaatcaaattcatctagatgaaactaatcattttgaaccccgcattgatctttacaatcaaaaattaaattaaaaaacggattgaagcctccaacatcatgaaggtttcaatccattttttgtttacacactagctttcgaatttagatatttcttttctgcttcctttcgggcctgaacagcgtcttcaaagtcagcaaaacttgaatttaaaactaaactacccttaaccatcatcctagctaaccatctttgagcatggttatcaaatgacacaccgattaccccgctggtatttctagccccaattttaatggactgaatgggatttccattaacatcttttaacgcatcaatatttcccatcctagctaaagtcgcttgattagctcggatttgataggctgctttttcttttcgtaagcatccacaactacgtacgctaccacgacgtaggcgataaccatccgcttcaataatgtttccacatgtacactgacaaacccaaaaggtgttacctgcggcactcttctttgatgcaactcgcaaaacttttaatctactaaattgttgcccagttagatcatatctaccccgtgagcaactaccgcaacttttagtgctacctaccttcaaatgctgtaactccacatctgtttcattaccacaatcacatacacagtgccagattgtattaccatttttagctttgccagaaggatacttggcgactaacttaccaaatcttttattagttatatcaatccgaattttcatgactaacctcctcatctggggtgtgcattatttaagccaaaatacacataaagttgtattttgaaggtacaccctaaaaaaacaattaattaccttatatttttaaacatatcaatagaatagttcagcacctaaactaagtatagctcaaaatgcttatcgttaaaataacttttttatacgatacagtttttgagtgtttttacgaaaaagtaattcttagatttcatttttaatccgataaataagagtccgactggttccagttttttgactaatactggtaattttttgaccagcatttaacatttcaatgatttaaaaatatgtttttcgtcgcgcttcatttttaacatctggtccaaaaagaactggacgacctttataaacccctcgctttttggccaattcgattccctgacgttgtcgaattcgctttctttccgactctgcttggaatttctttgtctcgataaaaatgtttcgtaagaaattgcgcatgtttgcatcatcaatatcatcaaaagtaggcaaatccaaaataactagtttggcaccttttaaataaacttccataaaaatgtgagtaagatattcattgtttcttcctaaacgttccatctcgataacgtagagctcgtcgcccggtttaggatgctttaaaaccttcatcaattccggacgttcattgattgctccagatattttttcttcataaatacgatccattccaacttattttaaacgttgtagttgacgtgccaagttttggtcctgcgagcttacccgagcataaccatatttcataaataaaacctcctagattttagacctttaaatgtctgttttttagggtgtaccctaaaaagcatggcatcatatataatattgcctaagcggtataatttttagcgttaattagttttatttatttctattaacgaaagaaacctttattttattataaaatcctcttagaatgaagtaatttagactatctacatcctgattcaataaaaatagggttacgacatatttaaatacgtcgtaaccctatttattttgtaaatttgttaattaaagttccgttagtgcgtcgtcaacagtttgcccaccatcactcatccggataacttttttgattgtattatcatgtttaagtaaggctgccaaaacctgagcaacgtttggaatagcattttgcttaccactaccgttgatggatacttttccagtaccttcttcttcagtaaggctagcaggttgtaaaatagtataatctaatttggtattagaaattaaataattatcggcaaagaacttagcgatattataatcagttaaatctgctaatccttcccgatgccattcctggggttctaatgaaaacattgagctgagcatgataaatcgtttaattccatttttttctgcagcttgcataacttttactgctccaaaggcatctgtctgcaaaaggtcctttccccgagaacctgctacaaaataaactgcgtccacatccttaatgcttttggtcatttcatctacatcgtcatgtaaatcaaaatgcactggagtgacatgttctaactcaattacacgttcaatctttctggccccagctactacttcatgaccatcactaactaaatccttaattagatgctctgcaactcgaccagttgaaccaactacaaaaattttcatattctgcctccattattaacttaatctactgccattatacaaaagatacgaataatgcgttggagagacgatttatcttctcaagctttatcaactggatggagcaaaacatcatttgatttaatttctattgagcttgcaacgtataatgctcaccagtcgcattcaatttgctttcaactagttcttttaatttttcaatggccaatttcgcacgttgagcttgatcggcattaattgcttcaatcaccatgacagcatcagttgtatcttcagttaacatcgttctctgggcttcacgccaattaaaacaacgacaaatcgcaccagttgcatcataataaattacttccccaggtaaagctggttcatcttcatctgagcctaaaggacgaaaactttctcctccctttgccgctcctagatgcatggttccatccattttttgtaagtcttctccgccacaaggaaccccgtattccaatgaaatactgttatagatgtctaccaatggattaatcggacttaatgactttccttgagacacgcgttttaaaagtgcttcaatcgaagcccgcgccccttttttcttcttaaatttagtaaaagcagttcgccactcactaacgactgggttatctcgaaaaacatcattagcaatatacttttgtgatttttctattgcactatctaataattcccgataaggttcatcggcttgagaccggttattaatccctttaaccaccaaaacttcaaaacgcgcctctggaaacatttgccaaatttcttcatccattttcaatgcttgcatcattaattcctcctttatgggttatccttgcttattatctatcaaaataggtgcaaatgcaacaaaaacattggcaaaaaaaagccccaattcaaatcgaattgagacttcttgaacttaactaaaattagttaagctttgtcttgctttgtacttcaagcttttcgttgaagtcgtagacaactggttcaccagtagccatttcaagattaataatatcttcatcagagatattttcgatgtacttgctcaatgcacgtagtgagttaccatgtgcagcaataataacgttcttaccatcgattaacttaggagcaatttcgtcttcccagaaaggaataacacgttcaagagtaaccttaaggttttcaccgccaggaatgatacgtgggtctaagttagcgtaacgacgatcgtttgctgctgaaccttcatcatctgcatccaatagtggaggaagaacgtcgtatgaacgacgccatgtgtgaacttggtcatcgccccatttttcagctgcttcagccttgttttggccttgaagagcaccataatgacgttcgtttaagcgccatgtctttgtttcaggaatccatagttggtctgaaccttccaaagcatagtgcaaagtcttgatggcacgagtcaatactgatgtgtaagcttgatcgaattcgataccagcttccttgattaacttaccagcgttttgtgcttgtttaacaccttcgtcactaagatctacatcaacccaaccagtaaattggtttgataagttccattgactttgtccatgacggatcaaaactaattttgccatatcgtttaaatacctctttcttgaattaaatttctaacattacaattttacaatttttaagcgattagtacaaactgaaaatgaagaagtttccacaaaaagccgattaactagctaaaaactattcttcaatggtatcacttataggaatatcttcattttcggttgaccttgattttgtcttagaggattcagctttagacgaactaccagtctgttcattttttttagtagaactgttctccgttgcactactgctggatgactcttttgcattagacttagctgtttttttagtaacgcttttactactatttttcttactaggaaccgttttatctggcacagctgcagatgacggaattggcccgccataacgtggtagaccctgttggcccgatcccgattccatactattctcgttattatccggcgtcgtatccgtattaaatgaattttgatccgctacaattccagcgttattaaaacgctgaagcactagggcttgatcataaatcgtcttgtaatactcttttgaaaattctttatcgcttaagagcccatcaatgattgcattagatccgtaaaaatcccaagcttcatttttttgcttagctgccgttaattttttattgaattttttaacatcctgcttaattttatcaattaatttaactttagtttcgctccgctgctttaaagtggccgaagcctttttataggtgagcacagtttgataatccccacgcgcactagtaaattcattactcttaaattcagaacttgctcgcatgtacattttcgtttgtgccagtaaattagcagcttgttgatcatctttcctaatggttatggctcgtgaaaaatagtttttagctgcagtgtaattggtctgatcaattgctgtttttccattcgtgatattgcgctcatactgtacttgttcttcgtgataatgagcgactgcatatccgccaacaacaccggcgaccagaaaaattaacactgcccaaatccattttttcattgcctaacctcccttatatatctgatttattataccacgtaaatagcatttaacttactgcttagtcttgaatataatgcttcacatttgaaaaaaatgtcaacaaagtttataacagtaatataactcttttattttagaaaggatctgacacaatgcttgagaaacaattttacaaatcgtttttaaagcggacatttaacattccagtacgcgtcaattactgggatggaagttctgcagtatatggaacgggggatcctcaagtcaccataacctttaataaggccatcccagttaaagctattctaaagaatgcttcgattgcactaggtgaggcctacatggacggtaccatcaccgtcgaaggtagtttacaacaactaatcacatcggcatatgaaaatgccgatagtttcttccataataagaaatttattcattttctccctaaacaaggacataatgaaaaagaaagtatggaggacgtccaaaatcattatgatattggtaacgacttctaccgtctttggcttgaccctaccctgacttattcgtgtgcttattttgaaagtgatcaagatacccttgaacaagctcaaatgaacaaggttcgtcacattattcgtaaacttcatccccaacgtggtaaaaccttgcttgatattggttgtggctggggaactttaatgctcacagctgctaaagagtttgatcttaaggtggttggagtaacattaagcaaagaacagtacaatctagttaatcaacgtatcaaggacgaagggctcgaaggagtagctgaagttcgtcttcaagattatcgtgaactgggtgatgctaaatttgattacatcactagtgtaggtatgtttgaacatgttggtaaagaaaatctcggaatttactttgaaaatgtagcaaaataccttaaaaacgatggagtagctttaatccacggcattactcgtcaacaaggtggcgccaacaatggttggttaaacaaatggattttccctggtggatatgttcccggactagttgaaaatatcgatcatatcattaatagtggtcttcaaattgacgatatggaaccactacgtcgtcattaccaacggacaactgaaatatgggacgtgaacttcaataagcatcgtgctgaagttcaagaaatgtttgatgaacggtttgtgcgcatgtgggatttatatctccaagcatgttcagcatcatttgaatcaggtaatattgatgtcattcaatatctcctcactaagggtgctagcggacgcgttctcccaatgactcgtgactacatgtatgaaaaataaaaaaagattcatgccgaagacaatagttagccttcagcatgaatcttttttgtattaatcgttcaacctataagctatataaaaaacacgctcatttcaacgaatgagcgtgtttaaaattgcattttacaatatttattattaaattattaacgttaaaatcattactgttacgagccctacaataactgacatcgccattgagcgcgtccaataggcaattagaataacaactagcccaccaataatcaaggcaagatttccactagtaactaacgtatatttgcttgaaataaagattcctttgacaaccaatgccgtaaataacgaaattggtacgtacttcatccaatcgttaaaccactctgggatttggcgctttgaaaagaatagtagtggtaaataacgtggagcaaacgccacaaagaaaccgagaataataatcaatagatgatctaatgaactgtactccatgcgtgatttctcctaccaaattaaagaatatctgactcttttttttcgatttcttcgatgattggaccacctttacgtgaaccaatatcttgtaataatgcactcgctggtcgtttttttaatagtaactcttcgattaaaaatccagtaaatgacgcgatcaaagttgatgccacgagacctaaggtactcttagttataatcatacatactgcagcaagggcacctgaaaagatacaaatcagcaatgaaagtcgagatttaatttgcatcacaatcatatagataaataaggcggtcaaagcaaaatcaactacagttagattaatactaagcacactaccaatcaatgaacccacaatattagaaacggtccaaaaaaggagtgaccagtgctcaacttggcgagcatcattaggggtccagtgtttatctgttgcaaattttaaatagtttacagcgtagttttcgtcattcaaggaaagagcaaatgtaaaaatcgaactacgactctcaccttgtagatatttcgataaacttgaacctagcaatgcgtatcttaactctaggaagaagagcatcaaaacaatcgtcaggataggagcgttaactgttaacatttgcgcaatcaaaaattgggccccacctgaaaaaataactaaggaaactaatccagtgagtaacgtattgaaaccagcagcatgtaatagaattccacatgctagcccaatcggcgtgtaacttaaacaaagtggccacgctactttaaatgtttctttccagcgcgcctccgttttaatttgtttcaaagtttgtcctccaaaaaaactagatataaaaagaatacattaattttttgcaaagcatacgaattaattctaacacgctaaataaaattttaatagtaaagccactaaatatccctctttaatcgcgtcctttaactaaaccaatcagctatagaacgccccaaacgaacaaaaatattagcttttttcacatcttgagttggtttcaatttcacatgtacacctttaccattttcaaggaattggtcctgattgcctttaacattcgccgtcgcaattaccttagaatgtttaatgggtgctttttgttttggatcatttaatttaattgcattgacatgcagtttttcgctccgaccttttggaacccagtaatctagcggttgggccagttctaatttaacatccgcaactttagctgagttaattttaacagaggcttgattctttaaattggaacttaaaacggccaacttagtcatcaacgcattccaaatcgttttagtatctgtgaaacgttgattttcactggaacctaatacgacactgattactcggtgacctttaattttaccggtagcagaaaaatcctctccggctttatctgatgtacctgtttttagaccatcaatttggtattttgtttcatactgttccgcgccttttagtagttcattatgattagtaatttcaagttcttcttttccagtattaaaagttgttttttggattttagtgatatttagaatctcagggaattcttttaagacatgggaaattacgattgccatatctttagcagacatttcgttttctatatttccagatgtgccagggtacttttcactaccaacttgactttctaataatcccgccgcgttgtacaattttgcatctttaataccccattttttcacggttgcccgcatttcattgacaaatttttccgaagttcctgcttgggcttttcctaaagctaaaattgccgcgttagctgaataaattaatgatgcatctaacaagttacgcactgtgtaggtttgattggaagaaagcagaacgttggttaattcactgttgttactaacttcttccaagctcttattgatagacactttttgattccaatgcatttggccctctttaacgctcttcatgatgaggtaagctgccacaatcttcgacattgaggcaatcggacgaactgtgttttcatccttgctatatagaatctggcctgtgttttcatcaactgcaatcgctgatttagcagtgatattactagtggttgcttcaataactgattcgttattttcagcagctagcgctggcgcaaaactcgtcatcatcattaaaaacgcaatcagcatcgtgtataattttttcataatctaactcctgatccgaataaaaaagactgttccaaaaggaagtctatttttcaatgtggtaactaacaagttaatctcttaaaatttagtcaccacaattgaagcgtagctctttgacgaatagctctaaaccatccttcaaatctttcatcacagtctttacatcttttaaattttctatggtaagtccttacttaccggttgatgcaatggcaactgaatcacaaagctcgttcgcttatcgttcgaatgagcttcgatagtaccattatgcatttcaacgatgctttgagcaatagctaatccaagtcctgttcctccagtggctttggaacgggaaccttccactcgataaaagcggtcaaaaagcttgccaagggcctcagcaggtactttttcaccatcgttagcaacttcaaaaattaccgtatcattaatttgtttggcactcaaaaaaatatttttaccaccattaccatatttcaaggcattggttatcaaattgttaaacacccgaccaattttttcggcatccccggtaatttctaaatctttcggcgtacattgagaagtaatcacaaaatgcttctgcttagcttccagttcaaaactagctgctaactgttgaagcatagaatccacattaatcgtattaattgtcaaatggggattagattgactaaccttggtatattcaaaaaggtcctctaccagtgatttcatctgaattgattttaaatatgctgtatgcgtatattttaaaatgtcatcttcatttttaaattgacgatcttcaattaaccttagataaccaataattgaggttaatggcgtacgtaaatcatgcgatacattggtaattaaatcatctttagattgcttaagcgctcgctcttcttccatggagctaatgacactgtcaaccagtgagttcacactatccaccactcgttgatggtctccacttaattcaaatagaatacgatgatcaaaatgaccattagcaatgtaatgtaattcggcaataatatgacgtaactgcatttgcttgtaacgtcgttctaagcgccaataaagtacccctgcatcagccaaaaacatgattaaaataaaaatcttttggtagctccaaatctgtacgccgccaattgtaattgaatttttaaccataaagaccgcgtttgacaaagctggattcgactttaaggcactatcaattaagataaaaactgataaattgagtaatagtaaaagaattaccgtaataactccttcaccaaacaattcatatttttcacgccccgttaacttcatttgaatctctcctagtgcgcgactactttatatccaacgccccagacggtttcaataaccttttcaccacccgtagcttcttcaatcttgtcgcgtaaatgactaacgtgtaccattactgttttagctgaaatcacactctcctgttgccaaacacgttcaaaaatctcatctgctgagaacacccggttaggatggctagctaaaagatataaaataccgaattcaagtgctgttaattgcacatcttttccagctaaggtccgaacttcatgtgaatcactgttgatgattaatgaaccaatgtccaaaatttctggttcatcagctgtcatatctttttcactacgacgtagaagtgattttacacgagccatgacttctagtggattgaaaggtttagctacgtaatcatccgctccagtcaagagccccttaatcttgtccatatcatctgttttagcagacaacattaagattggtagggatgaatccttacgcacttcccgaaccacttgcatcccgtccatttccggcatcataatgtctaaaatcattaagctaatatccggatcggtacgtaatttagacaaagcttcttttccattgtaagcagatactggttcgtaaccttcatttttaatataaatgtctaataattcaacaatttctttatcatcgtcaacaactaaaattttcattggtgaatctcccctttttactgtcttttttaccagtctagcaaatttcgttcaaaacacccgttactagggctggattttattaatctttaagaaaaccttccattttcagcagtttttcttttaattcaacccctgcccgataatttccaattttcccatctttacgaatcacgcggtgacaaggaatgactagcaaaatcggattacgtgccactgcactagcaacggctcgaatggctttaggtgtttctgctaattctgctagttccgtataattaacccctcgaccgtacgtaattttcgttaatgttttccatatcttttgttgaaactgggttccattacttagatcaattgctaaattaaatccttggcgacggttttcaagatattctttgatttgacgtacagcttcgatatttgatttttcatcttcaattaattcaattgcttgataaaactgatttacttcctttaacgtttggttcggtgagccgacaaaagctaagccctttttagtcgatgccacatagtacgttgcatctttcacttgaaatttagaataatatagtttcatagcatcaccctccttctaattttaacctgtaatcatcgtaaaataaaaaaagttaatagccaaggacgaatccttgaccattaactcttaaagtttttaattattcaataccaaattgaatatttatttactatttatggtagttaggagcaattttagtcatttgaacatcatgtggatgggattccactaaaccagcgtttgtaatttgcacgaactgtgctttttcagccaattcagcaatggtagctgcgcccacgtaacccattccagaacggagtccaccaagcatttggaagatgattgtggcaactgaacccttatattgtacccgcgcttcaattccttctggaaccagcttattggcttcatttacgccaccttggaagtaacgatcagctgaacctttttccatggcgccaaccgaacccattcctcgataggctttgtatttcttaccattatcttcaatgattgaaccaggagtttcgtctgtaccagaaagcatgctaccaagcattactacatctccacccgcaactagggctttaacgatatcaccagagaacttaattcccccatcagcaataatcttcttgccatattcacgagctacattagctgcatcatagatagcggtaatttgtggtaccccaactccggcaactacccgagttgtacaaattgaaccaggtccaatcccaactttcacaacatcaacaccagcgtcaaacaatgctcttgttccatccgcagttgcgacgtttccagcaatcaacgtttgctttggaaaatgttcgcgaatttctgctaccttacgaagtactccggctgagtgtccgtgagctgtgtcaattacgatagcgtcagcaccagcatcgattaaaccttgagcacgttcaaaagtatcactagttacacctacggcagccgctactaatagacgaccttggtcatctacagctgcatgcggattgtcttccagatttacatccgcattttttacgattgaaacttcggaagcttgttgttcagcactcatatttttatgaatgacacccaagccaccttgacgagccattgagatacccattgcagattcagtaactgtatccattcctgcactaataatcggaatattaagcttaatgttatcagctaattgagttgaaacatcagcctcattcggtaatacatggctttcgcctggaattaataaaacatcatcaaaagttaaaccttgttttgtaaacttgttatcccaattgctcatcattctctcccttttctttaactaaaatatgccaccaacgatatgaaactttcgtctaagataccaccgtccgccgaatgctgcaaccgctaatattgcatatccgtagaatggaagggtcggattgataacaggtggtagcattccaaagctagtatagaagataatccaaaggactacggcaattacgacgattcccgcttgtttccatacggaagggcgctttttactagatcctaagactttgtagatataacccataccaatcccaccgactgctgacgttaagataattgctagcaatcctgaaggacctggtgtgctagtaatcgtcttgggttcaattaacatcatgattgcgtacattgcagcaaacagagcggcaaaaattaaaccattatctaaagatctaatccacatattgttattttgggcttcaattttagctttcttaggcccttctacaatttcatttaatcgttgggttggggtaccaaataattgtttagctgttttaccagttttttgagcttctaataaccgagtttcagtatcaatcaaagcttcgctacgttgttcatcgttaagcttgctttctttaagctcttttcgtaaacgatacataaaatctgcattacgtttagttaattcttgttttttaggttcattttcatggtgggcaactgaactactttgcttgccctcattacgtggttcttcagtcataatctatttactcctcgtttgatttatattagacattaaagcggaattcgataatatcgccatcttgcacaaggtattccttaccttcaagacgtaaacgtcccgcttcacgaacaccttgcatactgccatacttgtctaaatcatcaaatgaaactgtttcagcacgaataaatccacgttcaaaatcagaatgaattacaccagctgtttgaggagccgtcattcccttcttaaacgtccatgcccgtgtttcttttccacccgccgtgaagaaggtttgaagacctaaaaggttgtatgaggcttgaattagacggtttaagcctgactcagtaattccttctgcttcaagaaattccgctttttcgtcatcttctaattcagcgatttcttgttcggtttcagctgaaatacccaaaacttgcgcatcagggtcttcttgagcaacgtaatctttaatttctttgaagtacttagaagcttcaggatcggccatatcgtcttctgcaatattagccacataaagtacgggcttagtagttagcaagaaaagtcctttaacaataggcatttctgattcatcaaaatcaattgtacgggctgctttaccagcttccaaaactggatgtaatttttccagtaccgctaattctgctactgcatctttatcgcgtcccttagccgcacgctgtaccttagtcaaacgtttttcgacactttccaagtcagctagactcaattctaagttgatggtttcgatatcttcgatggggtcaactttacctgaaacagttgtgatattgtcgtcgtcaaaggctcgaacaacgtgaacaattgcatccacttggcgaatattttcaagaaatttatttccaagtccttcacccttacttgcacccttaacaatccctgcaatatcggtaaattcaaaggttgtgtgcacaatctttttagcaggaataatttcttgaatccgatctaaacgttgatctggtacttctaccatcccgacgtttggatcgattgtagcaaacggatagttagccatttcggctcccgcctttgtaattgcgttaaataacgttgacttaccgacgttcggaagtccaacaataccagctgttaatgccattttaattccactttcctttcaaaactgcgtgttcttctctatatattatcaaaaattaggggtcgttaacagaccgttcagagccaaagttgcgctttcatcaccatcaataaagaaatctcgtatattacagttctattttttgattttagttagtaaaaaagaggcactacgatttgcaacttaaaattggcttatcataatccctcttacaacttattcagcgtgttcaacgaccttcttcaattttcgttcaaattcacgacgaggcaacatcacaatgtggccacatccctcgcatttaatcttaatatccatccctactcggatgatttcccaagtattagagccacacggatgacttttcttcatctgaacaatatcatgtaattcatattccattactaaatcctccttagtctaaagaaatattcaagacatccaaaatccgatcaagttcttggattgaatcataattgatttcaattttacctttttgttttgattttgctacaaccagtgcgcgcgtcccaaagcgttcccccaattgattttcaagttctcgaataaaaggtgatttgttctttcgtttttgtttttgagctgcttctcgatctttatccaaattaaatttagttacgatttcttctaattgacgaaccgttaatccctcttcgaccgtccgttgggcaagtttctctaaagcctgaggttgcttaattgccaacaatgttcgtgcttgtcccattgaaattcgtccctcttggagcatcaatttaacgcccgttggcagtcctaataaacgtaaataattagcaatataaggccgactcttacctaatcgttccgaaacctgtgcttgagttaaatttaactctttaatcattgcttggtaagcttctgcttcttctagcggactaagatcctcccgttgtaaattttcaataattgctgcttccatagtggcttcatcagaaaagttccgaataattgctggaacttgttctaaaccggctaacatactcgcccggtagcgtcgctcgccagcaataatttcataacgttctaatgcagcaattggttgacgtagaatcaaaggttgatagataccagatttttttatcgatttagccaattcttcaagtcgatctttatcgaagatatgccgcggttgaaatggattaggataaatcttagtaatatcgatcatctgatacgttgcgtcattttgtgtgttcaattgttcatttaatactttcttacccatcatgataaccttctatttcttgccaattggatctttacctggtgttccaggtttacgtggatacttatttggtgtttgctttttcttttctaccactactaaatggcgttcgtcaccagtcgcaggtagcgcaaaatccttgtccacgatcagcttaccgcctaaaatggcaatggccattttcccatctgaaagttcttgttcagtattggccgcttttaaggcaataaaaaatccgttttgtttaaccaacgggatacacaactcactcaagacactcaaacgtgctacggcccgagccgttacaatttcaaatttttcacgataaacggactttttagcaccaaaagtttctgctcggtcatgtaccaaagtcacatcggttaattctaattggtccaccaacgttttcaaaaaagtgattcgtttattcaatgaatcaacaatcgtgacttttagtgatgggaaaagaatcttcatcggtaaagaaggaaatcccgcccctgctcctacatcacatagttcagctcctgatttaaaatattcaggcgcctctaataggggggtgactgaatcataaaaatgcttgaggtacacttcattttcttcagtaattgccgttaaattaacatgttcattggtttcaattaacattttgtagtaggtagcaaactgggccatttgatggtcactaatttgatatcccttatcttctaaagcctttttaaattcttctggggtcatgtctgttctccttgtgaaacattaattgtttcatatcttatttccactttaactaattagtaaagatttagcaatattgtgaacacatttgtagtctaaagttggtcgtattaactagcaggaggatttagttttgactttagttatccaaaaaatcaatgcttatagacccgaacactacaaattactgttagatgccgacccctcccttagaagcattgccacctatttatctcgaagtaccgcgttcgaattgaccgaccagcaccagcccgtgggaataattgttgtcatgcctaccgaaccgctaaccgctgaaattatgaacgtggccgtcaaacctgaattccaagaccaataccttgggagtcgcttaattcaatttgtggtagattattttaacaaagaccctgattttacggctctaacgattaaaactggaacaactagctttaagcaactttatctataccaaaaattaggcttccgctgttctgaaattttaaccgattattttaaaaatccagaaatttatccaaatgatatttacgaaaataaaatgctattacgcgacgcaatcttgttaaaacgagccttaaaggtttaaaaaaatcccatgatgattggcttaggaaaaactaagctttaatcatcatgggacttttattcatttaaattaagcattcatctttttaacttcttcaataaaccaggcattgaaggcgtctgcatcaatatcaacacacacttcagcattggtctttccatcgtggtaagctcctcggatatctgcaacggtttcaccattcgccggtccttcagtaactacgtcaatccaatatgggatggtcttatacatttcgggttttagtaagtatgccaacgtattaacatcatgcattgggataccaccttcatttccctcgtaatagtggttaaaaatggctcccagcatttctccagccttacctaaggattttactgtgtctaacgtagattgcgttagaagagctttcatcgttacatctaggccaaccattactactggaatgccactcttatataaaatttcagcagcgtggggatcagtaaagacgttgaattctgcagcacttgtcatatttcccatgccaattgctccacccatggccacaattttttcgatcttggtttttacatcgggatgttcagtaagtagtactgcaatgttagtatacgatcccgtgggtaccaaaacgatcggttcatcgttagccataatagtgtgatataaaacatccactgcattgttaactggaatgttagtgggttctgcaccaaaatcgtaaccaggcattccagattcgccgtgaactcgagcagcatcttcaaatggtttaatcaaaggttgttctgccccaccagcaaccggaatatcagcgttgaagaattttactaatttcatcgcattcttagtagttttatcaaccgtaacattcccagccaccgtcgtaattaattctaattcgatttcaggattattgatggccacggaaatcgcagctgcatcatcaattcctggatctgtatccataataatttttgttgtcattttcttacctccagcttttatgaaagcgtcctcattaccattctaaaaaagaatgcacgttacgtccattctttttcactatctatttaaattaattaataattaactgttaaaaaagttaccagacgaacacgcctacaaatccagctgatagtaatgaaactaaaataccggaaagaagcatgtaaccaacattcttagaaattgcatcatttctttcacgatcgacaagacccttgaaagcaccgatgatcatccctgtggttgagaagttagcaaatgaagttaagaagacggtcaatgttgcagcaaaatgaggtgcgaaatctttcatcttaccagttacatcacccataactacaaattcattggtaactaacttggtacccatatattgagccatttggaaagcatgactagagtcgaaacctaataaccatgcaaatgggaacattacacaacccagaatgttttctagagaaagaactgggttaatcttacctagtaaagcatcaatcaaagcagccaaagcaacaaaggcaattacgttagctgtgataatcaaaatcaaacgaccagcgcccaaaattgagtcgcccaagaatgagaaaaatggttcgcgttcaggcttcttgctaactgtttcttcagcaactccttcagaaccagattcgatggtatctgtactttcgccagaggcacttccgccaatcttagcaattgtatcttcttctggtgttacagtaactggattcaaaactgttgtaacaataattgaattaacaatgttaattggaacagcagcgatgatatattgacccggcatcataagtaagtatgaacctaaaattgatgcagtaacacaactcattgacatcatggcaattgtaaccaaacgttgtgacttcatgttacgaagttgtaaacctgaaacagcaagagcttcagtgttacctaaaaacatcatttctacagcgaagaatgattcaaacttaggttgacgggtaatgaatgatagacccttaccaacccacttgataatccatggaaggataccaatgtaagttaaaatatcaaacaatggaacaatcatcaaaattgggagcaatgcacttgtaacaaagttcattgatttaacgtgtacccaatcaggtaacgcaaattcaatacctttataagaaacatcaaccaaagctttaaagccatcagcagcggctttaaccccgttaataccaacagacgagttaactaagaaccaagctaacagaatgttgatcactaccataataccaaccgacgcccagttgatatgtttacggtcttttgaaaatagaacagcgacgcctagaaatacaataataccaataatatttattgctaaaaacatgccgaaatctccctctatgatccaaattatgtaacagacgttgtaataataataactactaaatattagtctgtaaatacaaaatataaagatttttaaaaggttttcgtaaatcatccactacatcttgtggtgcggtccaaaatatgttaaaacgatttacctacagtttccagaacgctttgactgctttttgtaaatcgcttacagaagttactttttggtagtttttccaatgcctgggaaataaatttaaataacgggatgtgacaaatctttgatccattaacaaaatattacctcgatctcgtcgagttcgaattaatctccccgctgattgaagaacgtggttcattccaggtaattgatatgcgtactcaaatccatgaccatttttttcgtcaaaatattctttcagcaaatttctttccgtactcaagcccggtaatcctacacttacaatccctacaccaattagttgctcgttaattaaatcaattccttctgaaaagagtccgcctaacaccgcaaaaccaactaatgttcccgatttttcggtccgaaaagcatctaaaaatgctgcccgctcttccatactcatctggctagtttgcaggtgaacttcaatttcaggatgcatttcctgaaatgcatccgcaatttgatttaaataggcataggatggtccaaaaattaagtagttccccgtcttggcttccaccagagttgcgatcgaagcgatgatgttaggtaaatttctttggcgcgccgcatatctagtatcaatataactagtaattaaaagattttgctgtttttcttcgaatggtgaagccatctgtaaggtcaagcctttcgtacttcccaaagtttcttgatagtattcaacaggcgataacgtagcagaaaagaaaatcgccccgcgccctttttttaatgaggcatctaaataaggactgggatctagaatctgttcttcgatttttatattatcttcaggattttgaattaaaattcgataactttcatcaaaatattcactgatcttaatgtatttattgttggcaaaaaacaaatccaacatggtactggttaaatcgttatcaggttgtttaggcagccattcccggactacttcattgaagttcaacatggctttttccagcccgtctagtggactatattccaccatataatcttctgtttgatttttaaatgcttgatgaatcaactcaaattcattatctaattgggtcaatctacgtttaacttgtttcgagtccacgtcagtggttgaggattcaaaaagttcttgtgcttgaattaccaaagcttgctctaccaccgctgaatacattgctctagaacgcgacaccaaattatgagcctcatcaattaaaaagaaattactttggtcttcaattgtaaaaaagcgctggagatacaccattggatcaaacaaataattgtaatctccaatgattaagtcacaaaataaagataaatctaatgaaaattcgaaaggatctaacatatacttcttcgcatacgtttgaataacagctttgtcgaacttgtcttcattttctaaggcgtcctctatcccatcctttactcgatcataatacccaatcatgtatggattttcttctggtttcatatccacttcttcaggaaatataattcgatctttagctgtaattgtaatggatttaattctcaatccttgattagccatcaattcgatagcttcttcggcgacgtgctgagtactttgcttagccgtcaaatagaaaatccgttcaataacttcctcacccagggctttaatggtcggaaacatcgttgaaactgtttttcccgttccggtcggagcttctacgaagaggcgttgtttagttaaaatagttttgtaaactgcaactgctaggtctcgttgtccatttcgatactctggaaatggaaattctaatttgcgcgctgcctggttacgttcagtacgccaatcattgcgtagcttaatccacttttcgtattgtctaaccaaatcatcaaaaaattcggtcagttctgttcgggtaaatgtttgtcttttttcaatcacttcgtcggttggacgttgataataagtcagttgaatggtcactttgtcgaagtctaagtcttgcgtcaaaatcgctccgtaaacttttgcttggctccaatacaatgtcttagtattctcacttaactcttcaaaagtaggatccgaagttttaatctcttcgataaacaggtcatcgtcaataactactccatccgcacgaccttcaattgtaaaagcttccccatccatttcaacggctcgtttaacgtagtattctttttcgtaattttcatcacgttgcttttgcaatttacgatggatgcgggcaccctctaatgcagtattttgactattcatcgtcgcgttcaagtcacccgtacgcaaaataaattcaactagttgtcgaattcctatcttagttacgctcattcaactcacctctatttcttaactttttcattatcccataaaaccttttctagaatttctattttaaaaacgtatttatggtatgtaatcaaaatctaggaggatttttatgcataccaaattacttctatccagtatgaccgttttaatgggattaactttcagcattcatagtgtttcagcccatggtttttcaccacaagtagctccactttcagattcaccttcagctgaagttcaccacccatcgtcccagccctcttctgcttcatctaattcttttactgcaattcagacggtattatcacaacatatgggtcagccttacctttggggagctactggacccacagccttcgattgttcgggcttaactcaatacacctttaaaaaagctctaaatcttaatttaaatcgtaccgccgaacaacaatttaaccaatttcgccatgttagccatgatcaagtccatcctggagatttaattttcttttcttataatcatgggcaatccattgatcacgttggcatcattgttgaaggtcaaaacatgatggtagatgctcaaaatcggggcgttattcgtgaatgttatctagttccttggtggcgagggtacatcgctggatatgctcgagtaattgaataaataaaaaaaagaattccagctggaattcttttttattaaccaaaatgacgcttccaccaaccttgtttaggttgatcaagaattttttggttcttttcggctaattcgtcaattttttgttccaatttgacgttttcttcatggtaactttgattctgttctaagactttcgtcaaaagttccttaagatcagccatatccttgctttgcgaagcaataaagcgtttcatggattcatcgataacagctggtgtgttttctgatcctgtaacttcatcggtatcttcgccatctttactactgttgtcattcatccctagcgttgcctgtacagcttgctttagcgtatgacgatcaccaagtagttcgttcatcttagcaagaatttccatatcctcttcagaataaatacgacgtccacggccatcatgttgaaacttatgtccgctacgttccatttccttagcccaattacctaaggtggcaagactaccaattcgttctattttttcaacaacatctgaacctgtaacatattcatctgctataatatcttttgccattttttcacccactttgaacttaattttactacataatttgtaacaattgaagtacgatttcagttaaatagaaacctacctatcaacataattgctacttttcgccccaaaacgggtcaattgaaataaaatcaatcctaaaaattcaaaaccaaagattaaccaagctaaaggagcataactctgggttcccattattccggctaatggagaagctaaagcgccaataatattcattaataaacctaagacggctgaagccgctccagcatttgttcttccacctagactcatagccatggatgttgccaccgtattaacaactcccacgcaaaagaccacaataaacaggggaataattactaagatcgccattggacgtaataataagctcccaactaataatactcccgcaaacatgccaccaattaacccgccatttaagatatcgctatccttgatttgctctggtaggtagcctggaagattgttaccaagaataattcccagtccgttaattgcatataatagactaaattgccctactgtcatgtggaaataagtttgaaatacaaatgaagaagcagaaatatagctaaataatgcaccaaaaatcagcccttgcgttaaagcgactaaaataaattgtcgtttaccaaacattgctcccaaccctttgaaagtttgaccaagcgtcaagacttcattgttcgttaccttcaacgtttcgggtaaggtacataatacccccaccatcactaaaattccgatcacaaataatagtacaaaaatcccttgccattggacaatagaaagtaatgctcctccaataattggcgcaataattggaaaagcaccatttaccgccattaacattgcataaaatttagttaattcatgtcaattaaacaaatcacgcgccaccgctcttgagagcacttgcccggttgagcccgctagcccttgaattaggcgaattccaataaacagatagatattagtagtaaaaattagcatcaatgaggtcaccgcatataatccaaatccgactactaatggaactcgtcgtccaatccgatcactaataggacctacaattaactgtccaaccgctaacccgatcaaacaagatgtgatgctcaattgtaaggtagaagctgatgagtgaaaagctcgttgcatttcaggtagacccggcaaatacatatccattgataaaggtcctgtcgcactaacaactcccataaaaaatacaagccaccatttttttacagttgatatcttttcattcataacctcagatctccttttttaaaacttcaaattcaagtgtaacgaaaattagttcaaaatcacacatcaaattttggtatccttaatatgttagaattgttagttgacacataaaatcgaggtaatcatgaataacaaagaaaaaacaaactatcaaggcaaaaaaaaattcggtaaaaaacctagtgaccgtcaaaaacaagaccgtcggaagaatttttacaataatccccgtaaatcttctgacatcaagattggtgacgaaattccacttaaaattaaacgtttgggtataaatggtgaaggaatcggttactaccagcgtactatctgtttcatcaaaggtgcgcttcctggtgaaaaggtcgtagcatccattaccgatgttcatccccgttttatcaatggtgaagtaagtaaaatcaaaaaaatcagtcccgatcgggtaaaacccattgacgcatatgctggagaagtcggtggattcgaacttgaacatttagcctatcctgctcaacttgaatttaagcgtgatgttattcgacaatcactaactaaattcagacccgaaggctacaaacgtttcgaacttctaccaaccatcggaatggaaaaaccccttgaatatcgtaataaggctcaattccaagtccgtcgtttagatggtaaggtagcggctggactctataaggaaggtactcatgatctagtagatttaccaacttgtagcgttcaacaccctttaacgatggaaatcattcgaattgcggtcgaattattcgaaaaatacaacgtaagtatctatgatgaacaaactcatacgggaagcctaaaaacgatcgtagtacgtgttgctgacgcaactaaagaaactcaagtagtctttattactaatacgccagaattagaatatgtagacgaaattattgatgaattagcagctcaattccctgaaattgtttccttcatgcaaaatcttaaccctagtcgcgaatcattaatctggggtgataagactttaaacctgcgtggtaaggataccattcgagaagaattggatggtctatcattcaacctatccgcacgcgccttcttccaacttaatcctaagcaaacttctgtactttatgctgaaactcgtaaagccctcgagttgtctcctgatgacaatcttgttgatgcttactctggagttggaaccattggactttcacttgctgctcaagctaaggaagtccgtggaatggataacattgaatcagcgattgaagatgctaatgaaaatgcaaaaattaatggcatcgaaaacgctcactatgaatttggtacagctgagaaagttcttccaaaatggctacatgccggttttaaaccgaactcaattgtggtcgatccacctcgcgttggtttagataataaattaatcaccgcaattttggaatcagcacctgaacatttcacatatgtttcatgtaatccctccactttagctcgtgatttagttcgtatcgttgaaaaatacgatgtcgaatacattcaatctatcgatatgttccctcaaacagctcgtgtggaagcagtagttaagttaaaacgtaaataaaaagttgtgacaaaaggctgagtttaagcgtatagctatgagaactcaaactaccttttgtcgcaacttttttaatttatccatttatttttcttagcaacttcaatggcttcaagtcggttatgaacccctaacttactaaaaattgctgataaatgattacggaccgttccctcagataaaaacagtttttgagccattactttagttgcatccccactagctgcagcctttaaaactgacatttcacgcttggataaaggatttttatttgatgataaggctgtaactactaattccgggtcatacactgtgcgtcccatcatcactctattgatagtttcaatcaaatcatcacttggactatcttttaataaatatccagctacttctacttcaactgctttttcaaaataagtcttttgagcaaatgtagttaaaataattactttagtagcaagttgcttgtcatgtaaaacttctgcaacttctagtcccgacatcatgggcatttcaatatctaaaattgccacatccggttggagtcgttggatttctgctaatgcgcgttttccattggttgccgatcctaaaacttctaaattatcttctaaatttaatagctgatttaatgcagtatttaacatgctttggtcttctgcgagatataaagttatcatcgttactcctctggtaagttaaaggaaacttgcgttcctattttattttgttgaatatcaaattcgccatgtttagcacgcatccttgcttgcataccggaaatcccattagaaccctgtcgaataaaagtttgcgcatgtccatcatcttgcacttcaattcgatagcgaccctcagcatgaataaaacgaatctgaactgtacgggcttgggcatgacgaataatgttcgtgattgcttcaataattacagctgcaaattcattttgaacttcagttggccaatttatagcttcattttcaccttcagtcatcataaaaatattagcatccgtcagattcttactctggataaataaagcttcacttaatgattgttgatgtaaatcgttaacgatttgacggacaagctgcaaatttgctcgacttgtagtcgcaatgtcttctagttcacgtcccacttgatccgaacctttttctaacaatttcttagctaattctgttttaaccgtaatcatcgaaaagctttgacctaaagtatcatgtaagtcccgagcaattcgctcccgttcaccccgacgaacaatggtttctaagcgtcggttatcttgacgcatttttcgacggtagcgaatcgaaactgcaaaagcatatgacatgattggtgaaataattggaaacgccagacccataatgtttccaaatattcccccactagtattagtagtaatttgcgtaggaaataatccgataacttctactagcccgataattaaaatagtgtaatacgccccaaaaaaagccataacatattttttaggtctccccacaatcaaaaatgctacttgccaagctgtgaaaaccatcatatagaaattaaaattaaaaatggtaaaaattcccgtgattaagatttctaatggaatggaaactttttgccattctggtttttcggctgcccaaatataatctgctaagaaccctagacacataactatccaaaaagcatccgttgccgatttaattggtaaataaagcgaaatattatatggcatatataataaccagatataatattcccatttcacatttctaaaattccatttatttttaaccacgagccaatccaccctttcgtcgtgtgatgattgttcccactgtcattacggcgaccaatccaactatccaaacccctagaccctgaacgtcattccagttaattttagcattattcactgtgctactaatcatatcgttcaaaaaataggttggtaatttattaccaatattttgaacccaccgcggtaaaatttgaattggccaccaaagcccgcttaaaatagccactggaaatgtaattaagtttcctaaaattgttagagtttcttgtcgtttaacatgtgatatggcaattccaagtagtaacagaggtatttgacctaaccaaactagtcctaatatagttacccattgcatagtacttaaatcaacatgattgatcagaatcgccgtcgttcctaaaataacaatcgtaaagatgttcatcatcaaactccaaaaacaaatcgaaatataataatgatttaaattacgattagtaatctttaaaagcgtaattaatccttggttacggtctcgctccataaaattgccaacgcccataatggcagtaattaaaatactgtaaaccatcatgctccccatatattctgcactaaacgttttaatttggactctattaatttgcgtaaataggatgtaaaaggccgtgggcatcagcaatgaaaagaacacgaagccataatttcgaaaaattaatctttttccatcaaatttcagttgttcaatcatcttctgcattgtttttttctcctcgagtaatagtttgaaaaatattttctagtgaagcatcaatgatgttcaaatgttgaatctcctctaaatatggtactaagtcccttaacgttgcatctccattagtactactaatttttattttatttccattttgctcaatcgcttgaacttgagttagttttctaaaaatagatcctttacgtttagtttcaaaactaatctgggtggttaaatattgtttctgaagttcattcaaagtaccatcaaactcaatttttccatcttttaagattaaaatctgatcagctgtctgttggatttcttctaaataatgactcgtaattaatatcgtttttccttcatttttcattcgatcaacgttaatccaaaaatcttggcgagcgttaacatccattcctacggtaggctcgtcgagaaaaatcaaacttgcattactaactaaagtcattgcaaaggtaactcgtcgcaactgtccgcccgataaatcgttcaaataatgatgcgctaaatcacttaaatttaattcttttaataccgtttggggagctttaggattaggatattgagctgctacctccgccaaaatttctccaactttcacaccaggtaactttaagtcaccttgaaacattgatgcgactgattggctcattcctggacgatgtcctaaaattgatactttcatatttgtttttaataagcctaataagatttttaaaagcgtagtttttccggctccattttcaccaattaaaccaacaactttccccggctggacttcaaagcttacgtcttgtaaaacttgttgattgccgtagttgaattttaagttatttacgatgattgcatttgtcataattattcctccatacttatatcatagaaaatacctcttcgtttccctagtactgcttgtcaccaaaaagtatgacaaatgtcatactttctaagaacttcttaagttcacttaactccaatggattttcatagactttaagccccaacatctgaataataataggaaaatagtgacaaaatattctttggaggacccccaatggaacaatacattattaatttcgtaaacgactttggttatttaggaattattttgctaattacactggagaacgtctttccccccatcccttcagaagtgattttgacttttgccggcttcattaccctttcttccaagcttaccgtctggggtagtgtccttgcagcaacgattggagcagtgattggggcagtgattctatatattattggaagttatctaaccgtcgaacgcttaggacgtctaatcagtagccgccttggtaaaatcctacgtttaaaacatagcgacgttaccaaaactcataatttctttgtcaaacatggttccaaaacgattttctttggccgttttgttcccgtcattcggagcctaatttctttaccagcgggtatgactagaatgccttggaaaatctttgttttattaactacactgggaacgttgatttggaatgttgtactcattctgcttggtcgactggcaggtgaggcttggtccgaagtatcagctacaatcgactcctactcaagcttagttttaatcgttctgatcgtgctgtttgctggatcagctatcgtctactatttcaaacgaattcgagtaaaatcctaacctagtaatcgctttcatgttagaattaacctaacttattcagctaggaggaatcattatgcacaagcatctacctactaagcgtcaaaaacaacgtcttgctccagtggtggctttcgaaattaccggtctttttattgctttaaaagatattattactgccaaaaaattccgtcatgggtcgcgtggtctgtggttagctttagtatttattcaacctatcggaccttggctttacttctggttaggacaagctaaaacggattaatcggtcctaggaagaagatgaatttttttgaaaactgctgacgtcaaaagacgtttcttttggcttgtcatatctattattttaaattcggcggccaacgctttatccattgctacgggtttaggtagcgccgtctggacgggttctgcagtgaatctctcacattgggtagctcataccaccagccctgcaattgctaatcacgtgatgggaacggttttagttttatacggagtttcagtagcttttttgaccatgcttttatcgcgccatttggattgggctcgttttgcccgcaacattttatttgttgtaccgtttagttatctcgtccaatggttcacccctttttggagtgatactttaaaaatcagccagttgcaagctaattttcaacatccttggcagcttttaacttctgttattctggatattattggtttattgggcgtggctgtagctgtttcactctatcaacgggcgaatttgattatgcatcccaacgatgatctttcctacattctacgttttagatatcttcacggtttagcctcagtttcacaatgggctagttatgtcccaccacttatcatcaccgctcttagctgctttgctaacggcggccgattatggtcatttggtttcgggaccgtttgggcctttgttacccaaggttacgttcaaggttggtccgatcaacacgtagttccaacctttagacatcatttttcatttcaaagttcaaaaaagctttgataaaagggcgcattccatcgtgaatgctaacaaccttttaccaaagcttttttatttattcaatgttttaatgatttttttagcaacaattgttgcatactgcttggaaccatcaggattaggatggacataatctccatagaaccaaccaggttgatttttagaaggtgtaaaccagtcaattactgtcaaattcttgtattgcttagtcgctttatctaacgtcttatttaccgatccttcccatgtcttcgttggaacatggacattaacccagaaaatatgacgtttagaacctaccgcatcttcgactgctttaacgtccttatcagaaatcggaccattggcccctaaattaattaggacattatcacttaaagttttttgacgttttaattcggcaataataccaggcgcttcatcaacctgccgtccaacttttgatgacatataagctgttggaaaaatttcctgcaagtctgctcccgtatcttcgagaacggaatcccccactccggttaatggagttacggcagcaaatttcatttcttgatcagtcaactgatactttttagcgatttctttttcttgtttcgttagtttagcctttttttgcttcgttttggctgcactagtttccttttgtttttccaaagcttctttgtttttcttgtcggcctctttactatttttagctaatttagtttgtaatccatctgttttttgaaccactttttctggtgaagtaactgcaccaaatagagcaattaaaaccactaaaacagctggaattgccaagtatcgacgccattgtaagttagatttcaaatcaaaaatctttttcactagtgcaaaagtttgccgatagtcaaatttagctagtggaatttcaatataacgataagaaagttcactaattactaagatgattactagtggtgctaaagtgtttaaaactggatgagccgcaatattagtaactttttgttcgtaaaaaatcattactggtagttgatacatataaatcccataagaccgacttcccaaccatttgaatacaggattagtcaacaggcgattccacataaacgacggatgagcgatgatcgcaatcattaaaacggccagaatagagaatatgaaaattccaccataatatggcgttgcggtggtccccggcatagtaaagaatgtaattcccatgactaggattaatataccacccagtatattagcgattaaattagttctcgcatttagcgcttttttcaagcgagtcgacggccaaataaaagctaacgctgctccaatcaaaaatggtgcaactcgtgtgtctgaaccataataaactcgattaactgtatctggatgatagagaatggtcatcagcatcgatgaaatgatactaagagaaaatagaattccactcgcttgaacacgacgttctccaaaaattttcaataatactatcagtatcaatggccaaataaagtagtactgggccaacaccgataaataccataaatgcgtgaatggtgattctccattgtagcgatcaaaataggactgcccattatttacaagccaccagttatacacaaatactaaattagtccagataatatttctaatatgggatagtaggttttgcgcaaaaagtgtcatataggctgtacttgttaccaaaaccataactagggtcggatatagtcgacgtaatcgccgaatgtaaaaagaacccaatttaatttttccggttcgatcccattcttgtataaaaatatctgtaatcagataacccgaaacggcaaaaaagatgggaacccccaaatatcctccaggaacggtaaaaggcatcagatggtagaaaataactcctagcaatgccatcactcgtagtccatcgaagcctgtgatatagcgtcgttctcctacattctttcgctcaatctcaatagaagtcccatgtaagtcagatcttctcatcttttcgcacctctaacatttaaataaaccaaattttattccccacaatctattcctcggaatacccaaatgctgcgtattcttaaacttgttaaagtaccggctttagacccttacctatgcgttatttataatgttctcactttttttattaaaagttcaaaaagcacttaattattatgacacaactttaacattattgctgttataaataacgaagttactaaatgaatttaaattaacgattacctaattcacttttcgcgcttaaattttgatgataagattaatttaactttgtcttaaggagtgattattttgagaaaaattgcagtatattgtggggcagccgccggcaacaatccaacctacgctaacagcgcccgtaagttaggtaaatggatggctagtaataatattggcttagtttacggaggtgggcaatttggtttgatgggaatcatcgccaaaactgtcattgaaaatggtggtcatgtcgatggtattattcctgaaaatttagcagcacggggcgcaagctatcaagctgtctcaaatctccaagtagtcaaagatatgtcaattcgtaagcaattaatgatggatatggcagatggtttcattgccttacctggaggtcccggcacgttggaggaaatttctgaagtattttcttggtctttaattggtgacaataataagccatgtgtccttttcaatactaatcactactatgataatcttcaaaacatgtatgatcatatggtggtcgaagggttttcttaccagtcaagctcggcaaaagctcctttttagtgattccgttgaacaaattgcagaatttatgaacacctatgttccaccaaaaattcgtgaatattaacccgatgatgcgcatctagcgcatttttttgtacaaaattcctatttcagcatcattacaattaaaccaatggtaataattattcgaattataaaatgattccaattgatattgaaaaaaattagttgtccattaattaatgccactggtaacgccaatatcaatccgataattcccagccacggttgaaccaacgtcaaaatcatcaaggcacctacaataacatttaaggctgtaatccatgtttcaacttgtaccccaatcctgtaggcactaaaaatcaaaaaaccgccgtataacatcgttaatataattccaatcatatgtagcataggggtccactccttattatttctaatagagaacgctttctgaaactattgtaacaatttatctagcatattggcgaaaaactttgtagttgacattctactcccttatctatatagttagttacacaagtaattaagtgattcaggaggaggatttttatgattaatcaaccaatcgttagcgtttcgggtttacgtaaaacttacggggggaaaaacgaaaaacaatacgaggcattaaaaggaattgattttaatgttgaacaaggcgaatttgtcggaatcatgggggcttccggctctggtaaaacaactttgctcaatatgcttgctactttagaccaacctactagtggtaaggtcatgattaatagtcaagatgttactacccttaaaggcgacaaaattgcggatttccgggcaaatgaaattggatttattttccaagattttaatttgctagaaacgctaacagctgaagaaaatattgcgcttcctctatcacttcaaggggttaaaaaaagtgccattaaccaagcggttactgctgtggctgaaacactatccattcaagaccttttaaagaagtatcctacagaactttctggtggacaaaagcaacgagtagcagctgcccgtggaattgtccacaaaccagcactgttattaggagatgaaccaactggagcacttgattctaatagtgctcgtgagttgcttgaacttctaaccgacattaatcaaaaacaaaacgtttctgttttactcgttactcatgatcccttttcagctagtttctgtaatcggattttgttcattaaagatggcgttattggtcaagaaatacgtcgtaacggagtttcacggactgagttttaccaagatattcttgaaaaactcggaacttttgaacaataggaggcgaacaaatgttatctagactcgcactctcaaatatcaaaaatcgattacgagactacatcgtcctcttgaccggccttgtaatgtcttctgccatcttttatatgtttgccaacttggcaaccaacgaaggctttattaaaagtaatactacttttagatttgctgttcctgttttttattttggtgaggtattgctcgtaatcatcactttagtttacgtcatgtacgctaattcattcttattaaatatgagacttcacgattatggtttattcatgatgttaggcgccaaaaaacgtcgtgtaggaacgttgatggttttcgaaactttagtcgttggtgccattgccaccgcaatcggtttactactaggaattggtttgacagggggactttctaagttactattttcacatcttggaattacgctccatcattttaacccattctattttaaagcagtactgacaaccattattttgtatttagtactttttgtcattgccgcaatttttaatctacaatcattaattcgtactccggtactcaaattgcttaaacaaaatgatacagttaacaaaattaaggctcatggaattgggctttactttgcaggaatatttggagtgattttaattggaattggttactatgctctagctcaaattgctaccttcaaattaacttctattccaattgccctagttactatcgtgctagggagttatttaattttccactcaagcatgattcttattattgaacgtcttaagaaatctaattgggcacgtcgtaaattaaacaattttactttatctcaaattatgttccgcgttcaggattacactaagattttaacaattacgtccctcttgttcgccttagcattaggggccattaccgtgggctctgcgttcaaccgtcaaatcgattcaatggctaaaagtaatagttcctatactattgctattaacaatccaacagctaaagagcaaggtttgatcgaacaattatctgatcgtacagtcgttaaatatgaccaaaagtttagtggtaaccacgttatctataatgaagatcaatttgctcaacatccatataagattgttgaaacaactcaaagtaagtctggtactatgaatacgtataaaaacgttccagtttctatcagcaagcttaaaaaagaagttagcagccaatttgattttgtaagtttaggtggttctgttttagacacggctcctaaattctattccacaaacgattttaataaaattaacgccaaaaaaggttctgttagtttaattacggttaaaagtattgctgagaaccgtactgttttagagaagttaaaccatctccaacttaaagcttatccaacaatggatgaaactggcattggtgctggtaccttccctgccttcttaatgattagtgggatctatggtggactagaatttatcggctacttcttaggaattgcattcctagcaatgctagcaagttgcttgatgttcaagattctttctggaactcaacaagaccggattcgttataacttgctaactaaggttggtactcgtcgctctctactaaaccaaagtatcaatcgtgaaatctttgtgctatttgcacttccaggtatcctaggaattattgatgtactctttggactccaaatgtttaagagcttcttcaataataatccttatcaaaacatccaatatccaatcataatttttgttgtactatatctgttgtattacttcctaacaacttggttatataaattaatcgtattgcctaaaaagaaataaataaaaaggtgaacccatagaggttcacctttttttatatcctagtattcaattatttaacttgatgtccttcagccacatactggtccatatcattcttaggcaccatgctaccacccgtcgcccaaacaatatggctagcattttccattggataatcctgttccaattgagcttgaacgtcatctaaaatcgtaaaaccagaagcagctgatggttcaacatccacattttctgagtcatgcaattctgcaacattcttcatcatcttttgatcatcaaaagtttgaattccatataataatgtatccatcatcttaccagcaattctagatggacgcccaacagcaagaccgtcagccttagttactccatcgattccagcatcataaactgaaatttgatcatttaagccggtcatcattcctagcgaaactgatggaatatgagttggctccgcaaaaattggatgaacgttttcgccaataatcttctttagaccaaaggctacaccactaaggctaccacctactccagcaggcagatatacaaataatggatgttctgcatcaactttgatattttgagccttcaattgagcttgaagacgaactgcagcaaccgaatatcccaagaataaatcgtacgacccttcatcatcgatgaagtaagccattggatctgcttcagcagatttacgtgcttctgtaatagcatgggtgaaattgtcgttatattcaacaacattaacgcccttttcacgtaacatatccttcttccattgagcggcatcgctcgacatatgtacgctagttctaaaacctagtttgcaagctacaataccaatcgatagtccaagatttcccgttgagcccacgacaattccatattgtccaaataaatccttgaagcgtggttcatttaatttagcataattatcaccatatacaatttcaccgtgtttcattgctactttttcggcaaatttcaacacttcgtagattccaccacgtgacttaattgagcccgaaattggtagataattatcagccttaagatacaaatcacccttaacttggttttgagcttcggcatttaaaacagccttcatcttatccattttgagcaaaggggattctaaaattccatgtgctggtaaagtttctgggaatgctacctcaaaataaggtgcaaaccgttgaaaacgagcttcagcatcgaagatatgttcaactccaaccggtaattcagcttcctttttataattcaggttcttccaaaaaattggttcgtaagcttgcatctgcttaatcgctggatattttttgcttaaagcatcaacatcaatcataattttttatctcctcgttattgtattcacatttagtatacaacgcctagaatgctttgctaacccctatttcaagaattaatgtattcattcacaaattcttctttagttttaatttctttaccagaattaacaatcatcgcgtgaaaatttttccattcttcatcggttaaattaattgctgcttcaacttcttttttggcctgttcatacttagatggtaatggatgccccatccactcaaaaattcgttggctatatttatcagctataaaacctgcatggtcaaatgcgtacatcattaagtagtccgccgtttctggaccaatccccaccaaagccaataattctttacgtaggcgcaacgttggtaatgctccaattttttcgattgaaaactgatatttttgtgcccaagttaggacattttggatggtttgcgattttcgcgtataaaaaccgctgggacggatttgaatttgtaacgcttcattactaagccgcaaaatccgatgtggatcaaaattaaagttgttctttaaattcattaaacttggtgcgacattgacccaacttgtattttggactaggatgccaccatagactacttcccatggcgattcttgccactcttccaaccacggctgcttacccattttctgatacatcatcttgtaaatcgttggaatttccatgtcagtctcctccctctatgtattataattcttttccaaaaaaacactataaatctaaaattagcgttagaatatacttggaaacaactataagtttttaaggagaatttaaatatatgattgaaaaagcttgtacaactgttctagtcggaaaaaatgcttcaattgacggctcaactatggttgcccgcaatgacgatacatttttaccactagctccacatcgtttttatatgcatcccgctgaaacaggtgtagacgaaaccatcgtttcatctcaaaatggtttcacagccaaattaccagctaacggatatcgccataatgccgttcctaatattgatcccgataaagatggtatttacgacgaaagtggttttaacgaaaaaaacgtagccatgagtgctacggaaagtgtttacggtaacccaaatactttggcttacgatcctttggttcctaatggtttagctgaagatacaatgcctacgatggtcctaccatacatcgattctgctcgagaaggcgttgaatatttaggaaaattaatcgctaaatatggttcacctgaaggtaacggtgtgatttttagtgacaaaaatgatgtttggtacatggaaattgttactggtcatcattgggtagctcaacgaattcctgatgattcttatgcggtagctgccaaccaagttgccattcaacaagtcgatttcgatgatcctgataatttcatgtggtcagatggcatccaagaatttgttgaagaacatcatttaaaccttgatcacgaaggctggaatttccgtcgtattttcggtacagatacagaaaaagaccgtcattacaacactcctcgtgtttggtatggccaacgttatttgaatccagagattgaacaagacccacaatcttcagacttaccatttattcgtcaagctagccgtaaaatcaccgtggaagatgtcggtgccattttaagttcacactataacgaaactaagtacgatccatttggtcatggtgctgacgctgatcgattgaagttccgtccaatttcaatgaaccgtactcaaaattctcacgtacttcaaattcgtaatgatgtccccgaagatcgttcagctatcttctggctaaacttcggggttccagcattcagcccttacgtacctttcttcaataatgcgaccgatacagatcctagctatcgtgctactaaagctactatgaaccttgatgacgcttactggatgtatcgtgccgttggctcagtagttgaaggacactacagtaacttcatccaaaccaacgttgattacgtcaccgcctcaaaagagttccttcgtggacgcgttgctgaaattgatgctcaagctgctaacctacaaggcgatgcgctaactcaattcttaacagaagccaaccatgctactgttaaagcaatgaaagaacgtacgatgaaccatttcaacgatttgttagcttctggtttgttattatcaaaattaacctttaacatggacaaaaatctctaatattaaaaatgatgaacgctaaaccttaaagtttagcgttcatcattttttgttttataagatgtattcaccagctatgcgcaccagcgacgtcatttcttttttagctgttttgagccccacattcccccgaccatctggatgattatcactcagaatggatatcaaatagagatgtccattaacttcgacagccccaatcgaattcataatccaacttccggataaggtccagccgtttttattggctaagaaattaggtgtatcgctaaagcccttgattccccactgttgttttgaattaacttgaaacatctctgaaataatataattgcgacctgtacgactaattttgctcgactttacaaaaagatgtttcaataatttaatgtaatcttcggaactaactgttgaaagccaccacttactactagcttgactatgatccatccccagtctagcaaaagtagcatttaatccgctaactccaccaatttttttaaatatagccgtagcatcagcattactactctgacgaatcattcccgcaactaattttttatcactagctgttaatttagcatcttgatggagtaatccaattaaaattggaactttaacggtacttgctgtatacatttggctaatcttgccttgactccaacgatacgttttttgcttggcgacatcataaatggtaaaatcaaaattttcattttttaaatcagtattcgtttggcttagcttgccaacttttttatccatatatttactaaatcctgaatttggtgcttgtttggttgtaatgtgcgttgtagtctcagagcgcgagtgtaaaagatggtgcacttctacaatcaataatgtgaacgaaaatacaattagcaaaaatcccgtcaaccagattttccctttgcgatttaatcgcctaccgtgaaatgtcactcatctatacccctttaaaattatatatgccagttcgattataaccagcaattgacgtctatacaatgtttattttttgtaacattttcccaaatttaaataatttaattactggtcttaaatttacttgaaaaaacaaaaaaaaaactggaataagcataattaatacgcttactccagtttttaaaaggtgaatttataggccttaggattttactttaacatttgttctgcagttttcttgagctctgcatcgttcatattttcccactttttggcctccgcaatggtcttcatcgtatcatgaccgttgtcatccattacatgattccacattgcgtctcttaatggcgtttgatcgttactccagtcaaatacctctgtcatcttttgatcaagaagttctgtctttaatgttgttgccatattaaaagcctccaaaatgcgtgggtgaacatcatctgataataatgatgtcgttcatttttgttgcaccccacgactacgttataacaccagttttaaattttgttaaataaaaagccacagcttttttatagttgtccccaaattctatcttttaaggacactatatttctgccgtgacttttaaactttagttattttctgtaaagataggttcgtgaattgtttctacgtattgcgctgcttttggtgttacatacatgtcttcaccatctttttgaaatagcttagccgcacttaatttgtccattgcttgtcgaacagttgcttcatccaaaccttgttttacgtaattaatttttagatgttgggctttcccagctgcattagtaaattctaagtctaatagtttcatagttactcctccaaaatttttaagcttgatatatgaatgccaattggtttatttagttttgattacttttctaagataactttttcagttgttgtaatttgagcatcagttacattatcagtagacaccatttcaagtattttagccagttccgttacttgttcggcagtgactgtttgcgccacgtttgaaaaagctcttcgaacccctttttcatgatctgggccttccattgtgatactgattcctgttttcaaccaagttttaaccatgttttcatcctcatttcttatcatttaatataagtgtcgcgacgacttacacttactaataacgaatcaaaattaaaaatgtaaactaaatctattaaattttttatatcttatttggatagactactatgttaagctttgatgacttttaatagctaacatagattttaagttaatctccttttataattagtttattagaacaataagtatcaatgtctaccaaatcaaaggagaaaatatttattatgagtagcgtaattggaactttacttattatcgctattgcagggctacagtacctctgcagtcgtattaaatataaatattcaggtgcagtaattccaattttatttgcgggcagtatgctgtactattatttaattgctcaaaaagctagtttctgggcctttttaattattctcgttgtgggagaaattctcctcctcagtatttgggacaatcaatatcaaaaaaatgaacaaaagaccgaacagacccaccttcgtaaaaaatagcctcctctgtatcacacctatagttcttactttatgtctccaacttcctggatcatcttacatataaaacaacatttattgtaggaaaacgcgattaaatttgaatttaagtggttggcaacctttttattgaaacttaacttaatttggttgataatatagaaggaaatttaacaacatcaccatgtttgtttaaacacggcgctggttatggaggaaaataatggacattaatcttgattttccgttaggatcatcaattataaatttggtattgagtcatcgaaacctcgccaccaaagaaattcgcaaacttggactttatccggggcaagatttaatcctggtagagctattgcgcaaagataaccgctcacaaaatgagctggttaaagcgctctgtgtggatcattcaacgattgctaaatctgtaaaaagattactaaaagctgaaataattaatgctcataaatctactgaagataagcgggtaaccataattagtttgaccgttaaaggtaaggcgttagctattcaggccgctaaggtatggaacgatgtggaaaaaaccgcttttaaagatttttcgccagcagatattaaagagtttatgcaatattcacaacatatagcaaaaaattttacggatagaagtttagaactaaatgataaataattttaattgcatctctttctagctgatacccagagttcatcttaaaaataaaagcaatcattacctccgcatttttaaaatgttggaaacgatatgatttcacgtgaaacctatctaatttctcacatatgggggatcatttggttgacagcgttttcagttcgaggtatattgtaggtgtactagaacataggtttcccagcccataattgctctagtatgggtattgaatgagcctttcaagtaccctattagtgctcatatacccttcttacccaaagagtggatctgcttccccagatctactttttttgttgctttagaatttatatttgtgcgtaatttaatcagactgaattatttaaaaaaatcatcattataccctattaaccattgacagcgtttccaacttgaagtatattatagataatctaatggatgtaggtaactccctaagccgattatcatccattagatattcttaccctggttgcgtagtacttcccgaagcacagctttcccaaactacgtgacgtaatattcttacccaaagaaacacccatctacttccctagatgggtgtttcgctgtctctactgctttattcctcacttctttccgagttcctaaccttaatctaggacgtttaaggttattacttcatttattaaaaaacttcctatacctctaaacaatcaaaaagacgtagaagaggtttgggttatcctctactacgtctttttaataattattatccaaccactttttcgccatttaggtatgtcttatctagcttcatttctcggtctaacacaataaaatcagcatcgcggcctggtaaaatgtgtccacatttgcccccaattcctgcgctatcggccgcatttgcggtggccatctgtatagcttgttcaggagtaactacattccaatcaaccacgttctttatggcgtcttttaatagtaagatactgcctgctaaactatgactgctatctttcaaacgagccgtaccattttgcacaataactggaaattctcctaaaatatagtcaccatctggcattaaaccagctttcatacagtccgtaactaaagctaccttactaggagttttggcatctagtagaatcttcactacatatggattcacatggtgtccatcacaaattaattcatctgttacaccttgtaagcttagggctgcacctgccataccaggttcgcgatgatctaatccactcatcccattaaatgtgtgagtgaacatggttgccccagcctcaacacaagccttggcctgttcaaaggttgcatcactgtgtcctaaagctaccgtaaccccttcagagctaatttgagccgtaaattctactgcaccatcacgctctggtgcaatcgaaattttacgaatcatgccattagctgctgcttgccattcgtgaaattcttcaatactagggttttcgaagtatttcggattttgagcccctttatgtttttcagtataatatggtccttcaaagtggataccttgaactttagccccttcaaagtgatcaaggttcttgctaattacttgaactacttctttcaactgttttgaactagccgttaaagtcgttggcaaccacgaagttaccccacattttagtagcccattagccatggcctcaattccttcagcacttgcatccatcacatcgtgattcaacaagccatgaatatgggtatccactagcccaggagctatccatttatcactatattctacgatatctccatctggttgatttttttgatatctaccaaatttaccatcaacaacttggagataacctcccatttctacattactacctaaaaagaatttttctgcatgaatataatattccaaacttctcgctcctatccttcaaaatcgtgaattgttacaccttttactactcggttaactgtccccgttgctgaaggagtgtccggtgtattcttaaccttgattgatgatagtaaggagatcgtttgagcaaacattacatcagggaaggccatataaccatctgggatagaatcatctccattagcaaaattaaagttgctacctgtaaagttgtgggctgattgaacaccgatgcccataacgactggtgcaatctcgtctcctaccacttcttcaagaatatccacatcatactgacgagtgtaagcattgttgctaacgaaatcaaaaaggagtgtcttactattaacaaatgacttaggaccgtgtcggaagcccatcgaagtatcaaaaacggtcactttttgtccagctgttagttccaaaaccttcaattgtgcttcacgagttagtccacccaatgcaccagatcccagataaacgatccgttcaaaatcggtatcaaccaatttctgaatatcatcaacccggtcaatcacttcatgacccattttactgatggcgttaacataagtttctttctgttcatcagaatgttgagcatcgaaaactaataacgttgtgagtaacatgcagctaaaactaccagtcattgcaaaacctttatcattggaacgtgctggttgcattagaactaagtttttatcatcttcttgggcatggagcgcaagtttaccttctggagcacatgtaatggttatttgatatagatgtttaacgtacttttcagctatatctaccgttgctacactttcggggctgttaccacttcttgcaaacgaaactaaaatcgttggtgtatctttttcaagatattgtttaggggtagaaacaattttagttgtatcgattgcttcaaaacggaaatggtttcgatcaccattttcagttaagtatggcatcgctgtatctccaacataagctgaagaaccagcaccggtaaaaataactcgtaccggttcgttgaattcgctttcaatctttcctaagaaagcatcaattgcttgcttcttttcttggtagattttaaaagtttctaaccatagttctggttcttgttgtatttcacgagttgttataacagcacccatttgggttaattcattatcagtcattttgtacatagtgggaattctcctctcatccatcaatgcttatacttaatgttataaacaaattggtcaccacgagcgctactaatggtatattcaatgatttcatttttatgattgtatgttgttcgacggagcatgaatcctggtgaattaggtgcaatctttaataaatcggcatctttatcactaataatccctactgaaagcatctcatctgctagacgaactttttcaccatagtcttctagaagaacattatagagcgaacgttgtttcgtttctaactcataaattgacagattttcaaatttttcagcaggaaggtaagttcgatcaatcatcattggcattccatccgccaaacggagccgtttgagtttaacaatgggatctccaacattaattcttagcttaccactaaaatattcatcggctttacgctctgacatttctatgatctttgtttccggtttgcgaccaagcgatttcatttgttccgtaaaactatattcatcaccaattttagtcgtatcatccatccaacttgctacaaaagtccccttaccatgctggcggtaaatatacccgatgttttctagttcacttaaggcttcgcgaaccgtattacggctcacttcatactttctcataatttcacgttcggataataatttgtcatttggtttatagttatttttaatttgttttcttaattcatcaacaagctgtccatatacaggttgcttttcattatagttaaatcccatggtttgattaccacactttctaaatctgattcataatttatatgatataccaaatttaggttttgagtggcaattaatgttaagctttaccgattatgccaagtgctgatagcacaactgccacgataatcacgataaagatagcttttgttgaagtcattctctttcgaccaagcatccaatagattgctccaacaattaaagcagggaccaattttggcatgatcatatcaatcttatcttgtaagttaacggtcatcttccctaaatgtgctacgaaaatcacatgagtattaaccatagtagctgctaaagcccccacgacataaactccaagtaacgttgctgcatccgttaaagcatttagctgtccttgcatttcattaactaaacttaccccttgcttgtaggcaaacttcagttgaatccaacggaaccacataataacgaagttaactaacatccataaaatagcacctacaacgttaccttgaaccgccatattagcagcaattgctcccatgatagcaggcaccaaagcggcaaaaattgaatcaccaattgcggcaaaaggtcccattaaacctgccttaattcccgcaacggtttcaagtgaattaacaccttctttttcttcaatcgccatatcaattcctgaaataatagtattaaagaagttacttgtattaaagaattgattttgcattttcatcatttttttcagctcgggagtatggtcaccatacattttacggagctgaggaagaatcaagtaaagataaccggatccttgcatacgttcgtaattccatccaacttggttgaataagaggctacgaatattcatttgcttaaagtctttatcagttaatttataattagtcttattagagttcgtcgccatgaatctcaccatcctgttcatctaaatctgttgcaccagcattttgtttaggttgtgcagctactaaattgctttctttaacggaacgattgtactgcattgcagctagcgcaaaaccaatcaaagcaattcctaacattggaaggtttgcgaaaacggtcgtgaactttgcattcattccggcaatagttgtgccaagtagggttacattgccataaattgttgaaagcattgctgtgataacaaaacctaaaattaagtatggccaatgctttttaactggtagataacgaagcaagatagcaaaaccaacggcaggaagaagtgcgcccgcagttgcaagaccgttacttaaccaagctaagttggtattcatataatctacggctgtacgtacaaatggaccaccaaacgcaagtgctagaaatacaggaataccacgtgataatgtccatggaagatatccataaaggtaatttctttcaataccactgtaattttcttcgtcaattaatttatcaattctgtgttggaagaaagtattagcgaaacgtgcaacaatatcagtctgaatcatcaaactagcaaccggaacccctaaagctgcaaccgcaacttcgggtttcatacccgtcccaattgcaaaagccgtagccataactgttcctgagtttgcatcaattttagaagctcctccaaaagttcctaccccaagcacggttaattgcaaactaccaccaatgatcaaacccgttttaagatcacccattactaaaccggcaataatcccggcccagattggttgacttaaactagtttggagcgttaactcatccataatctggtacattgaataaattgttaaaataattacttgccatattgcaatacctgaacccataagaacgcctccttcttattttttagtatcaaattttttcaaaattgccataaagtcattggcttgatcaccaggaaccatttgctgagtgattttaattcctttttcatgtagtgccttaaatgcatctacatcgtcttgcactacattaatagaattagtgatttgagtcgtctcatccgtctgtgacatatttccgacattaatcgtttctaacttcactccgtcgttaaccaagtccaataatacttgtggtcgtttaaccacaataaatactttttgcgaatcatagccgccacgcttaatatgatcagcagctaccttttcagagagcacactcaaatcaataccagctggtcgagctaatttcaaacccgatttttcaatatcgcttgcagccactttgtcatcaatcaccataattcttgttacaccgagcttcgttgtccacaaattggctacttgtccatggattagccgtccatcaattcgtaccgctgaaattgtcatactactcactcctttgttttctcaaaactatgctaataaaattactgtttctaagccttttagttgatatgggatggttaatacatcatgctcaatccattccggtttaaccgctaactcttgaagttttgctccttcatggaagtaaagtttccaatcttgttgttgcttagttttagataaatgaatttgaatttgtttttgatcatcaatcgtgaaatttgaaagtacaatttgatttgaagacgccgtaatcttagttccagccatatcaactacgtaatctatatccgtagttttatttaaaataagttttaaaagcttagctttaattgaataatattgcgattcccaaccatatttagggtcggtattcattggtaaaattatcgtccgcccattgataatggtcatcactggtcctaatttttcagccttcgcactatatgcacttgataaaatttcaactttatttgcatcctcataagcgattttgtaataatcccccgtatgttgaagcatggtgacccgcggattctcaatttgatcaatgaccattccatcaatttgttcgtaagattgataattggttcgagcccgcttaatttccaatttttctgcatcaattaatgttctcaacgttggtctttcaaacaaaatttgaacactttcaccatctaaaaacatgacattctttttaagcaatgctgtgatttgttcatcatttagattgttaaaaaattggccactaaccgctaacacttcgttttcaaaattgcttgtattcgtccatttttccggtttacatgccactcctaaactacccaaaagtgataaccaactgtactctttaggtaagagttcctctgagttttcgcctctagtagtctggaggttaaacgaggcatcctgagatactaaaacttttactccatcgagttgttccacattcaatcgatgttgagttcccaaattcattaagtctttggattctgccaataattcagcatagtcatacgtttcatcgattccattccccatcatatcgaataaattcagcaaaattcccgtagcgcccagcatttgtgtactttccaattgcaatttagtaaacattcttgatttaacaaatggcgaatacatataactttccagctcaggatatacgtctgaatttttgccaaccaattccgtagtcactctggagtaacgttcaaaatctcgtgaatattgtaaaggagaaacttcgttatatgctggtaaatgtggtcgactaactcgtaaatgcgtaccagataaactatcaaatagaccgtcccaatcgcgtccttcaactgcatgccattcgggaaaagaactcatcaaacccaaccttgtggtgggagaaattctagcgaccgtcttttggattaaacgggcaacttttttcatttctactcgcgcaacactgagatatattttgcgttcaagcgtgggtttccctagttgtaagagctttttgacaaattcagtacgggttaccttacgtcctaatttttccgaataaatcttcatatgccgctcacaaaaacatgcaagtttgattggtgtgtgattgtaatgtctaaaatcatcttccagccataattccttaggttggagtttggcatattcaccgtagatatcagcaatatattcaacccacctaggatctgcaggacaagcgatggattcagcgtgttgacctcgataatcaaccatcgttccaaaacccagttctggactaactttttgtccacgatcgctatgcatcagcgttgtccatggatttaaacttgttgttatgtccatctctgctagccgtttagaaacctttgctaccgtaggcaaccaatgcgttctaacttgatcgatggtaagatgcccttggtttaactcttctgggttaataaaaaagactacattgtcaattcgagcttcctgacaaaatttaattaacttcttcgctcgttcttcattccagttaaaaggatcaattgcgaatcttaatgaatattgataggtttctgccatattttttacccgtttagttttgcatttacgtcaataattccattttgtgcttcgtcaattacagattgtttacttacttccattcccatcattacttgattggcaaaaccaatcaccatgggaagactcaaaccactaactacttcaagttctggatgttcagccatcaaacgaaccacaacattggagggggttccacctagtaaatcaaccgccaccattgtcttttcgttattggggttgtcattgataaactgctctgcttcggcctgtaaatcttctggaccttgattgggttgaagcccaatagccttcatgttatcaatatgcccaagaatcatctccgcactagctaaagtttcaaccgccatatttccgtgactcattaacaataatctcatgtaacattcctccatccctgggtttgtaattatgttgtatacgcttacaaacacctgtaaataaacagctgatattactaccagctcaattcatatcataactggttggtaccagtttgtcaaccaagttataggcgctaaaaatgcctttttcatgggatttttatactaaatttttcgcgtttatattttggtatagatggtataaatttacaattttcaccagtatcatcactatttattaaaaattcttcatagacattttcaaatcggtttgttcaataaattagtaataaaaaaactttgattttttacaaatcaaagtttcgattatattaaattaccttcatctaaattaattaaaaaaggagcaatcggatcattttgttcgttgtataacgttaagattggcgcattactatatccatatcgagcttgcgtagccccgttaggaaactcaacaacgacttgatcatccttaatctttgctggaatcgattgccaaacaccattaactaatccttcaatatggcaattttgggtagcatgtatgtgttggacgcctttaaatttaaggtggacttgattcctatctttaataattcgattaaaaaccggcgtacttgaatacgttgtccctgccagaattttccctagccgtgtgccagcaattcttttcgtaaccggatgaggattatataattcccctgtatccgttatagaaactaggtgaactgccgctaaagtttgactcactttcagcatttgttgcctaatttctgcccaagcattccgaagtacgttagcatactttggtaactgaataatatagaatggcaacgaatagtcttggaaaactctgcgccaatcattgataatctccctcaataacacatcatacaaatgacgcgtttcaatatctgtctcaccttgataccaaaccacttgatcgaatgaataatttttaatctttaataccattgctttaaataaggtacctggttttaaataactatctggcgttaccggtggtggccaaggcgtttgtccaacaatattaagagccattcccaatgggacactaggattatctttcataaatttatacattcgtcgattatgacgctgaactttttgacgatataattttacctcttcttcaaactctcggttgggcttattttgcagttgtttctcaaatggacgaacgatttcatccatcaactgtggttggctagtaagcgtcaatttcgacaaccaagttgcagctaatgccccgtccctagtacaacaaacaaccccgatcggtagctgaggatcttcttcggtcatccgcttaactgcataaaaagccattgccgaaatgtgtccgagattagtagtctttaactgatgccagtgggtagtttttgattgatagacttccacttgtccattttggaaatgaaatgcaggctgcggaacgttataataggagatattgttcaatgtgaaatgatttacctcagtctcaaaatcctggtcttgtgccatccgaaagcctacattggattgtccagccattaaaatcactcgaccaaaacgcaccttttttagtaagatttgttcccgatcatctgcaatttgaacttcaaatgaacttctagtatcaatcactggatcaaagcgacatgtccaccgaccatcgcgttttacaattgcacgctttatatctgaagcaatttttacttttacggttgaacccgctcttcccgcaccgctaatctgaaatgattttcccgccggcaaaaccatattatccgaaaaaatttgatcaacatgtaattcgaaactttccatgcttaacctctctgaataaaaaggccagaccctcccaactaacagatcggatctgacattttatgttacctatctttttagtcttacttaaattcaatcccgtattcaaacgtatgactttcaccagcctcaagaaggttattgcctttcttattattccagtccgttggctggtcgctagcttgatctggaagccctgcaaatggttcaatgcaaatgaagggttgagtttcatgttccatcgcccatagcgttagatatgggaattgtttgatgttcaatttaacttcatgagcagtttggttggaatgaagggtcacattttcaagcttcttagcattcaaaataataagtccatcatcaaacatttcatgatttaaagctaattcactagcttggattgatgtatatggagcttcagttccatcgcggaaagaaatgggccccactccgagtcttttaatttgtttttgttttggtccaaatgttaggcgataatcttcaaaaacaccatcatcatcaattggaagattaaaagctgggtgagatcctaaagcatatggcatcatccgatggtcattattaatcacccgatatccaatcaaaagctgattctgatctaatttgtattcaacttgaaggataaaatcaaatgggaacatttcctttgttttagcatttgactttaactctaacatgactcgattttctgcttgattaactttctgccaatcaaaatctcgtgcaaatccatgttggggcattcggtacgtcttaccatctactatatattcatcgttatttgacttaccaatcgctggaaatagaataggtgcatgtttcttccaagcatcaccattccaaatatagtcatagccactttcgtttccaataacatgagtcaattgagctcccatattatcaatttcaacttcgagacgatcgttttttaactttatcatatgaatttagttccccttccttatttttgtacagtcttagcatgattcatttccattaaaatgtaaaggctttctttggctttattcgacaattttaaccttcatctgaacttcaacaccttttgtaattagttcgaaactgttatgatagaattctgttagaaattttgttccacctatgacacttctcccattctttgggttcctttggtcatagtaaaattagtgacgtttacgttataaaggagaatttaatatgtctagttctaaaataaacacccgtgagattgttttatctgccatgattgccgctctttatgtggcaattacatttgtcttttctgctattagctttggaccaattcagtttcgcttagctgaaatgttaaactgcttagtgatttatgacaaacgctatatctggggcatttcgttgggagtcttaatttccaatatgcaatcatctttaggaattatcgatattacatggggaaccctcacaactatcgttacgctttcaattgtttacttagtcattcgtaaatttagcgatacgaaggtaaagatgggcatctgtgttgccatcactactgttctaatgggctttttagttgctattgagctcgcctatgttttgaaagttccatttttctatacttggggaacggttagtcttggagaactaggcgtgatgctaatcggcgccgtcgtaatttatctacttggagaaaatgttaatctatccctatctgctcgcagatagtaaaatctactaccaaaccaaataactacaagcctttaaaataggttcaaattaaatactttagtataatttacgtataaagtgagccttttagtcgaaacggagggactcagcatgcatcaattatctaaagtatttttgattaccttagcatctttttcactggttggattagctggttgtgcagacaaaaaatcagccacagcaccagctactgaaaaagcttcttcacctgcccgcgtccatgaagttcaacgtacaaacgtcactactatcgctctggctacttaccatttgatgaaatccaatggccaacttgaaaagcttaacgatgacatcgaacccagcgcaagaaatgttgtagaagatactgataataaaaaaattgctttcgatgcgggaactgagcaaaatgattattttgaacaaaaagcccatattactatcgataacaacaaggtgctttatacaaccaaacaagataataccagtgtcgatagcctctataaaaagtattccaaaacagttagtttccagcgttttttagatgaatttgaaattcaagaccatgacgaagattttgacgactaaaaaagctgaatcaagaaaagttcttgattcagctttttatagtacctgatttattcaaacaaatttttagagttaatcttctaaattctcaactaccactttacccatcatatggtttccctcaaccagcttatgcgcctgttttaggttctccacgttaattggggataattgcttagtcagggttgaaatcagttctccagcgtctaataaacgagcaatttcgtccaaatatacatgctgagtctccatgtctggtgttccatagtaggacttcgtgtacatccattcccaagcaaatgtaacccgtttacgttttagtgctttcaaatctaccggttcatggttttgagtgattgaagctatcctgccattcggtttaatcagctcgaccatttcatcccaatgcgcatcaatattgtttaactctaaaatataatctacgtattgatgacctaagttacgaacttcatcaatcaagttattacgatgattaacggtttcgtcggcgccatgttttagacaccattcaatagtttctggacgagaagccgaggcgatcacatgtaaaccggctttttgggctaattgggttgcaatggaacctacgccaccagccccattaataattagaatcgacttatcggcgtttccttgcacatcctctcgatcaatttctaattgttcaaataatgcttcccacgccgttaatgaagtcaatggcatcgcagctgcttcagcattgctaagcttttcgggggcatgtcccaccacccgttcatctactagctgatattcactatcgcttccggcccgtttgaatgaaccagcataaaacacacggtcgccaatttcaaaatatccagctgatgcgcctttagctaccacagttccaactgcatcccaaccaatcactttaggttcgtctaaagtttcagtcccatttttacgcaccgccacatcgattggatttactgatactgcatcgactttaaccagtagatcacgtccttcaggctgaggaaccgccgtttcaaaacgaaacaaacttgcttcttcattgatgggtaaatgtttttgaaatccaattgaccacattattttattcattttggtaccattcccttctttaaaataacgctatttcttctataattgtacctcgaaaattgttaaaacttgttactaagtaattgaaaatagccatgttaactaaattttggtgcctaatcttgttgttgtcgttgcaaaataccttcagtaatatcagcaatcgttatttcatccattttttgaaaggcactttgctgtatttcagcgtatgcatcatctaacacgtcttgaatactgccaccaacaacacactgtggatttgtcttagggtcgatatgcaagaggttatgatccatatccaccgccttataaacatctaaaatactaatctcactcgcacgagcatttaacgctgggctagcactccctacttttgtcgtaattagtcccgcaattcgtaaatccgacatcaaatttcttacagtactagcattggattcgatactatccgcaatggttttacttgataaatcgccgtccttataaataattaagtacgtcaaaatatggattgcatcgcttaacttataggaatacttcatcgttaccacctaatttaaaatttcgttaatagcctctggtaaactagttaattcccgacccaaaacttttgctaaactatctgattgatgactgagagagccatcttcaattggtgcctgaaaagaagtaaatagtgccgcagtatctgcatctaagcctcccgcttgaagttgagcttgataggcatccctcgaaatctgcttaacttcaaaatcatttccagttgctgtttgaagggctgcgcccaaatcagcatacgaacgaattttaccagcaaattcatagatagcatctggattttctagcgtaattacctttgcagcagcctcagcatactcacgttctaaagcccatccagcttgctgatttgtccagtaggttgctgtttgattattagcaccactttgtaaaaagcccatttcattttgaaggtaccagttgttacgtagaaatgagtgtttgattccttgttcttcaattagtttctcagttaatcgatggtcgtttgctaaagcactggttgatgcttgagcatttggaaaactagtataagctacaaaatcaacacccgcatttttaattgctgttacaacattttggtgttgagttcctcgagctactttaccacctggttgcgaagaaataaagagcactcgatcaatccctttcagagctttttccattgtagttacatcatcgtaatcaccttgacgaatttctacacctttaggaagtagcttttgacctttttctagatttctaacaatggcgattacgttgtcggttcctactaaatcaattaatttttttatcgcgatttgtccaaagtttcctgttgcagcagtaattgcatatttcatattcataattctccttaagttgtttttttattattaacagcttaatcataccacctgttattttaaagtcaacaggtttgaacaaaaaaactcacttaccttgaagttaaaattcaaaaataagtgagttaatttttattacaaatcatttttttcttagtgaaaaccaccaaatcaaatggataatcaaaatgatgataaatataaaagccaaaagaccgattccttagctggcatgtcgggaatcggtccgtttatttatcttatgactgtaatatatttcaaattctttttaaacgtgaattggtagtcctgcagctaattctgctgcatccataatttcttcacccaatgttggatgtggatgaatggttaattcaatatctttaattgttaatccattttcaatcgctaaagttagctcagaaatcaaattagaagcttccggacccacaatttgggctccaataataccgccagtaggattgtccgtaattagacggataaagccttctgtttggtccatagtcatggcacgtccactagcagcaaatgggaacttacttgatttagcatccaacttcttttcagcaatagattgtggagtttcacctacagttgctaattcaatgtttgtgtaagcaacggctggcaaaacataatgtgtatcatgagcatcttcgccacccatagcagctgctgccaccttagcctcaaaactagccttatgcgctaaagctggtccagcgaccacatcaccgatagcataaatatgtttaactgatgtttgcatggaatcattaacttcaattaaaccacgcttacttaacttgatattggtattattcaaaccaagttgatctgtgttaggacggcggcctactgaaactaaacagtagtctccggtaaccgtcttggttgttccatcagcttcataggttactgtaacatctttgtcagtttggtttgcctcaaccgctgtagcttcagtaacaatttcgactccatttttcttaaagttattcaaaactggctgaatcaattcgccatcaaacccatttaaaatgtgatccaaaccttcaatgatggtaatctttgaaccaaggttcatataagctccagccagttccgctccaatcaccccaccaccaataatgatgagatgttctggaacatcttttaagttcaaggctccagtggaatcaattactcgaccactaaacttaaagtgtgggatttcaactggacgagaaccagtggcaatcaaagctctcttaaagcgatatacatgggaatcatctccgttgattacgttaaccgtttcgttatcattgaagtaagcttctcctcgcacaatttcaactttgtgtttcttaagcaagagttccactccaccagttagtttgttaacaacctgattttgtttccattcttgagttttagtgaaatcaattttagattctgataccgaaactccaaatggattaccatgttgtaaagttgagtagagatgtccagcttgaatcaaagctttagatggaatacatccaacattcaaacaaactcctccgatataatcacgttcaacaatcacaactttttgtcctaattcagctgctcgaatagcagcaacgtatccaccaggaccagatccaataattaaagtatcaacgttaattgcttgtgtaccaactaccatgactacacctccattagcatgtaggcagggttactcaaaagtgccttcagctcattcataattttttgtgctagagcaccgtcaattaaacgatgatcaaagctaagtgatagttttaatgtatttccaactgctaactcaccatcttcgttaaccactggagtcttacgaattcgtccaattccaagaattgcactttcacctggattaacaattggtgtgaagaatccacttccactttctgaaccaatattggtgatagtaactgtgccacccttaagttcattaggcttcaaatcaccggcacgaccacggatggccatgtcatcaatttcttgcgcaacttccataattgattttgatttaacattcttaacgtttggtacgaaaagtccattatcagtatcaactgcgaaactgacatttgtatcttcgtaataaacgatttcttgtttttcaatatcaaccattgcactaagttcagggtacttatgtgctgccccagcaagggctttcgcaataaatggcatatatgttaacttgtagcctttttgtttagcttgttccttaaattggctacgtagatccattaacttagaaacttctacttcatccatgattgttacatgtggaatcgtttgaacttggttagttaaagtcttagcaattactttacgaactggtgacaatggtatccgtccagctttaacttcagctggcgcagccggagtagctggggcacttggcgccttttctgattctgtttctggaactgaagcggctggggctgggcttgctgtaggtgctaatgcaggacttgctttaaagttctccacatcagccatggtgatatgtccatgccgtccagttgctggcacctgagttaaatcaatatcattttttctagcatattctcgtacagatggcattgctaacaattgtccatttgaagtatattctgcacctaccttggttacttcaggtgcagtttggttagctggtgcgcttgattctggttctgtagatgctggtgtttctttaggtgcttcactttcagcaccagcgccacttccgtcaccgtcgaattcaatcaatggttcgccaaccttaaccaccgttcccgcttctacgaaaagttttgtaatttttccaccataaggagaaaggatttcttgtaatagcttatcattttgaacttcagctactgcatcttcttctttaatcgtatcgccgacttttactaaccagtttgcaatttcgccttcagccattccttcgccaatatctggcatcttaaaaatttcagtcaaagttcacgacctccttaactttttcgatgatatcgtctgcttttggtaaccattcattttcagcaagggcaaatggatatactgaatctggagcagctacccgtccgattggtgctttcaaactcataatgaagcgttcactaatttcactcattaccatcgcaccaataccagcttgccgttgtgcttcttgagctacaacaactcgaccagtcttttcaacgctttctccaattgtgtcgagatcgagtggactaaccgttctcaaatctacaatttcagcgtcaatgccgtctttagcaagttcttctgcggccgctaagcttgtatgtaccattccaccataggtgataattgatacgtccttaccttcacgaatcacattggccttatccaatggtgtggtgtagtaaccttctggaacatcgccacgaattgaacgatataaacgaagattttcaaggaagattaccggatcattactttcaacagctgatagtaacaatcctttagcatctgctggagtagctggcataactactcgtagaccaggtgtttgagctactaaaccttccaaggagtccgcatgcatttcaggagtcttagttccaccgccataaggagagcgaaccacaattggaaatgtacgtattccatggaaacggaaacgtccacgtgccatctgtcctgcaagtgaatccataacttcatatacaaagccgaagaattggatttccataattggacggtagttttgggttgtcatcccaattgccattccaccaattccactttcagctagtggggtgttgaaaacccgattttcaccatatttcgcctgaagaccatccgtagctctaaatacaccaccatttttaccaacgtcttcaccaaagataactacattttcatcgttagcaagagctaaatcttgagcttcagtaatcgcttgaatatatgttttttgtgccatgattacttgccctcccctctaaatttgttaatttgttcttgtgcagcttgtcctggaacttctagagtttgttcaataaagtctgaaatcttttgtttatcgattccatctgcttgttttacgccgtcatcaatttgttcattaaccacttcggtccagtcattttcaatttcttcagaccagagacccaatccttcaagatattttctgaaacggataagtggttctttcttagtccattcatcaatttcttcttgagtacgataacgaagtggatcatcaccagacatcgagtgtgcacccaaacgattagtaattgtttcaataaatacaggtccattaccatcaactgcccattgacgtgccttcttggatgctaggtacattgcaattggatccattccatccacaaccaaacttggaagaccagctgcccaacctttagctgctagatgaggagccttagtttgtaatttacgtggtgttgagatagcgtattcattattttgtgagaaaaatacggcgggtgcgttatatgcgccagcaaagttcattccttcgtaaaaatcaccttgcgaagtaccaccatcaccagtgtaggcataagccacattaggttgtttacgcatcttcaaacctagggctgcaccagcagcttcaacatattgagcaccgataataatttgtggcatccagccattaacatcatcaaattcatttccttcataatggccacgtgaccacaagaaagccttataaattggccaacctttcattactaattgcggaatatcacgataacctgggaaaagccaatctcctttttcaaacgcataatttgaagcaatttgagaggcttcttccccaatggttggagcatagaaacctaagcgtccttgttttgctagtttagtggaacgttcatgtagcacacgactaaataccatctgtttcataagttcaacgagctgatcttcattcaaaccagcctctttaagggcatccccgtctacaatctcaccatcattatttagaacttgtagcattggaaaactgtctgtttgtttttccatttgaagattgaaatctaacacttgtttattgtcatcttttacagccataactaaacctcctaagcttcaaataatttaattaattcatcatccgtaatgtttccgaagtaccggccttcatggttacgttcaaagacggtcttaatctctgcagtttcaaatggtaacccaataaattggtctttgatttcgcgccaatcgcgtaaaccaaggaaatcgcccgtgaaattgatatcacgtatggttccaccctcagcttggacttgaacatcgataattccaccgtcatatttagcatggttcttaaagttaaattctggtgaacgaccataattccagtcccaagttgaaaacttatcagccgttagttggataatctcctgtttttgttgcggagttaacacaatctcttggtctttcccgtgatcggttaattcgtactgaaccgcatcccagaaatcttgaagggttaacccttttggagctgcatctttgatcattcccactcgacttcggaccgatttagcagcttttgaaatgaatttttcatccgctacatttaaggaacgaaccatggtatctacattactatcaaatagcaatgttccatgatgcattaagtatcctttggcatagcgctgggctacaccagagatttttttaccatttactaacagatcatttcgaccggaagcctcggcatcaatccctaaagtatgtaaagctcttaatacgggctcagaaaactttttaaaatcaacatttgctgctgattcaattggtacaaataaggtgaagttcagattacctaaatcatggtaaactgcgccaccgcccgtcactcgccggacaacctcaatttggtgttcatcaacaaaatcttggttaacttccccaaaagtattctgattctgaccaacaataatagcattattattctgccaaagtgcaaaaactggttccttggcatttaaattatttagtagccatgtgtccgttgcaatattaatgtacgcatctgttcccatgtatgtgacgtatcgcacaatctaaacccccttatcacgctaatggaagcgctttctaagtacatctttatgatagcacatttgaaccgttttagggctattttttgggtttaaaatgttttaaattgaattttggttttgtgcaattttgttcaaaccttaacattaaatttacatatttgagcaaagttgttaatttttataagataaaaagactagcttcgaaagactaaaaaacctcaaactaattctgataattagtttgaggttttgatttttttgttgattttttgaccaattatagattttcttcagcttgaatttcagaaacacgttcactaatcttcaagaatggtaagtataagaatactccgaccacaataattaagatttgtaaaataactgcgcgccagtctccggctgttgaaagatatggtccgattaaaggaggagttgtccatggtactaatactactgttcgactgacccagccccaaagtgtagcaaagtaacccatcaaactcccaacaactgggaataaaacaaatggaataatcaaaggtaaattaaagacaattggaaaaccaaaaatcatcggttcattaatattaaagattcctggtgccaacgataatccagcaatttgacgagaagatttagctttactaaaaattaaaatagcaataatcaacgcaatcgtactacctgaaccaccgattaaggtgtaattacttacaaatgaagttgtaattatatttggaatggcttggtgatgtgcataagcagtcatgttttcgttcatattaactaatacaaggggatcaagcaatgcacctgataatacggtttgatgaatacttaaaccaaaaaggaaattagctaaagtataaattacacagtaacccacaatacttgtattaaagcctcgtaaaggttcttggatccaagttttaattaagttgattaaatcggtgttgaaaaatcctgccagcaacgctgcaataatagcaaaaaacgacattaataaaatggctggaattaaaacactaaatgaagcagaaactgctggtggtacattttcccctaagtgaatttgtaattttttaatcgaggcaagtttgataaagaggccggttgcaatcagcccaacaaaaatcccaccaaacattccttgcgttcccgtattcaaataactaagtccacctgtgaccgtcgccatttttgcccctgctgaagcaaccgttcctaactgaatgcttcctggcattaggatgaaaatacttgctaaagacatcgcagcagccgcaattggattattaaagcctttattacgagcaagactataaccgatcattggcgcaactaaaattccggctacatttaacgtcccattaacaatggcgtttccaatcacttggaattttgtcagcatatccccactcaaaaaccaggtaaagacaacgttatttaacagtaccccaattccggctacaataaacattggtaaaatgacggcaaaagcatcacggagtgaacggagatatacccagtttccgactttaactgagatttcagtgaacttagcaatgaatttagaattttgcatcttatcattgactgattctttgttcgaactacccattttaaatcctcccattaaagatcattttctaaatcgttcccattagtttcaataacttttttaaaccatctataactcttcttagggacccgtttcatatcacgtaactcgtggttgccacgatttacgtacaccatcccatagcgtttttccatatttccagaagaactaggaatgtcgattaatccccaaccaagataacctaagactgggacaccgtcttccacaaccgcatcaatcatcgcttggatatggtcacgatgatattcaattcggtaatcatcttgaatctctgtcccatcgaatatttcacgataaccgataccattttcaattggaaacatgggaataccgtattcgttgtaagtcttagtgataacatcacggaatcctaatggatcaatgttccatccccaatctgtagcctttaaatatggattttcgacccctccataatctagataacgattaggcatcgttccctgtggaattttggttgaatcaacaacgttacttgcataataactaaacgaaataaaatcactcttcaatttttcaaatgctatttgatcttgttctgtaaaatcgatatcaaaatgatgattcttgatatattgggtaacttcagtcgagtagtggccatgtacccaaacctccaataaattacgattcaaaaattcatcaatttggcgggccacataaacatcacgcggacgacaatttttaggataagattctacatatgctaacatccctccaatttgagcatcaccagtttcatgcacataattagcaacttgggcatgagcggtcattacatgatgggcaattaactggagttcttcgtcggtttggtcacctttcaaatagcctgcaatgtggaaagcttctgtctgtgaatataagttttgttcattaaaggttacccatagtttcacacgatcactaaagcagtccaccattttcttaccaaaacgtacaaatgcgtcaaccacgtggcgactcatgaagccgttgtatttttccgctaaatgtaatggcatatcaaaatgatacaggcaaatcatcggcttgattccacgtttcagtaaatcattaattaatctgtcgtaatattggataccttcttcattaaagtccccatctccggtagggtttacacgactccacgaaatttgaaaacgataacaattcattccttgattagccatcaaatctaggtcttcctcataatgatggtaattatcaatagcaacatcccagtttgaggtagtttcggttgcttcatatgtatcataaactgttggtcccttaccgccttcatgaacacctccttctgtctgcatgcttgatgttgagtttccccataaaaaattatctggtagttttcctttcaaaataacgctcctctctaattgaattcgctttcattatagctttattttttatttaagtaaatacttttattttaaaagactatacttttataaaaattgtgattgtatttaagatacgctaaaatgagggtaacgtcttagaacggagttttaaacaatatgtataaatacgaaaaaatctcgcaagcgattcgcaaacaaattattgaacaaaaaattaaacctggagctttactgccggatcaaaatcaattagctaaagaatttaatactactcgtataacgattggcaaagcactccaatccctaattattgaagggcttatctatagcaaacgtggtgctgggacgtttgttagaaaagatgctcatttgaatgacgaatttactaacgatgttgataaacctttggggactacctcgactcatccgcatagtaaagtcaccagtaaatatattcatttgactgctcggattgctaacgaagtcgaaaagaaaaatcttctactagaagatggtgagacggtctacgtcatcaaacggacgcgttttatcgagggaaaagcttatagttatgaacaaacaattatgccaactaaaattgcaacaataaccgaagaagttttaaaaaaatctatttaccaatatctagaacatgagtaccatttagaattagctggttcccatcgacaaatcactgcccgtaaagtttctgaagaggacgctaaatttctgggtgaaaagttgggcgatccaatcctagtgattagccaaactagttacttagtagatggaacaccttttgaattttctgaatctcgttttccataccaatctagcgcagtgtctgcggatgtcaatttacttgaataaaaaagcgttcagaaaaattttctgaacgctttttttattttttaatttttaaaatagattctgtacccattcgtttagaagttatgcggtttacttgtgcctgttcatcttcaaatcctaagccaatcccaacgataatttccttatcacttggaatatttaactcctctcttaaaatctgcggatacttcacaaagttatatgcaacgatcgagccgataccttgttcagttgtgaccaacaaaatattttgactaaacgcacctaaatcaaacaaagaccatggtgtatatccttttggtaaggtcaaataaactacagcttgagcattataaagctgattggcttcttcacctaaagtttcttgccaattatcccctaaaactgttggtataccacgactccattcagccatgttcttttgggcttgttcagaccagcgcttccgcgacattggaggaatatccgaattagtttttgctcctgtaattgccaattcctgttgttgctttctaatagcttccaaagtctcaccttgggctacataaactttttgcggttgcgaattgacccatgaaggtgctttttgagcaattccaatcatttcttttaattgttttgaatctattttttgatccgtaaaatggcgtacggaatgacgcttttgaattgcctgtttgacttccatcctgtctaaacctccgaatcgtttattgcaaatttagaaccatactgcaggttttagtatacgtcttaaagtccactttaagtcaagagttgaaaaagtttattactcaataatctaccaaattaactttatcagaaattaacatagctttattttcactttcaaaatccattttagcccataaaccataacgacccccaaaagctagaatcttagtctaacttttgagggccactataaaattatgttgtagttctttttatttatcagtattttctgcagcaaccttttggaattcggctactaaatcggcattttccgtaaccttaaagttcattccatcgctagctgattgagaagttactaatacttctggttggccattatggaacgtaaataagtacatgtattggtcaccagtatatacagctactaccttgtattcactgtctgccttttcacttcttgtccattgcatggaaacctcttgctggttgacatatatttgtcccttagagagatagtcagggaaacttactccaccgaaactaacggatgcgttagcattcgtacctgtgtaagtttggcccatggtttgttgccaacttgaaatgaaagctgccaattctgaatcttgtttgtcagtccaaattttcttttcagtctttttagtcttctttgaagaagattgtgctttagatgaacttgatttaccttcttcaactttgatcacttttgtactacttgatctatcagaagatgaagttgtgttcgtgacgtgattaggataaaagaacttataccctgcaatcacgacgattaacgcgagaataacccaaaccaccgaattgattgagccaaacgagcgcttttctggttttttcatatgtcgcataataatcacctcgtttagtctattatacagtaatttgataaattggaaattaactgtaattactcttttatagaggactacttaatttataaaaaatcacattacatcaaacctgacgtaatgtgatttttaattaccttctatctttcaacttcttgtaacttttgattgtcatctagttgagatttaccttctaaatgtttcttttgaagttgaaccatgctgaaccatagcaatgcaagagctataattgcgaacaataatagagctcccattgattgaacaaccgtgatatttcctaaaccagatgtaatggattgacggaatgacaagattgagtacgtcaatggcaagaatggatgaattgcattatagaaactgtttgtaacttccattgggaaggtaccacccgaaccaccaagttgaagcatcaatagaatcattgcaacgaatcgaccaggattatcgaaggccatcgacaagaacataacgatgtacatcgacgtcaaagcaatcataattgcggttaagtagtattgacctacatgatcaacatggataccagcaaccatcataattgttgcttcaatcaaggccattccaagagcaaccgctgtaccaactgatactttactcaagaaccagtctgtagctgtaccaccacgcttagaaatcttacggattgggtaagcgaagttaaagacgatagcaccaacataaagggctaatgaaagcacatatggtgccaaagcatgtccataatttggaacataactgtaatcagtttgtttcaaatgagttggagcagcgaacatttgagcagttttgcttgtaagaggaacactgttaacttgttttgaacccttttctaaactatctgctagcgtaccattaccatcactaatttgtttgctaccgtcaagcagctgatcagagttagcatctaattcacttgcaccggcatttagcttattaacgccgtcaattagttcacctgtacttccatttaaggtttgaagtccatcatttaaggtatgacttcctgaatctaactgttgaacaccgctaattaaggttcctgtacttccatttagagtttgaagtccgctattcaatgtgtgacttcctgaatctaattgttgaacgccacctacaagagctggaatttgaccatttaattggttaagtccaccagtaacttgtgatgatccaccaactaattggttgctaccagcagctaacattcctacaccactaaccaaggttggcatttgtgaactagcagtactgataccaccattaagttggcttacaccatttactaaagcagctccgtttccactaagttgagaactaccttgagttaattggctaattccagattgtaatgccggcatttggccattgatagtagttaaggctgtatcaagtgtttgagcaccgctagttaacttcttaacattatctgaactcttattagtttggctagctaaatcacttgcaccgttgttcaattgcgacacaccatcagataacttagatgctgagcctgagaatttatctacggcacctgaaagcttgcttgagctatctgagaggaccttcaagttatcagtaacactttgtgatccttgagccaagtctttaatcttagcagctaatgtggccatttcgtcaccgtttgcagaaagtgaatttattcctgaagcaaccttttggaatgaagcacttaaagttgcaatcttagcatctaaatcagcttgttttgaagataatgaattcaattttgaaacttgaccttcaacactactaatttcaccttgaattgctgaaattttacttgtatcaatagtttgtgaggttgtagttgattgggctgtgcttgcaccagaaccagcaacacttgctaaagcggccttagctttagctgcatcttctgcggatagaccagctccatcaattttagcgttgattgtagcttgtgatactcctgaggatgctggtgctgctttagtagtagtcgttgttttagttgaactagctaaagcaccgacatcactcttaattttatttagttggctactaattgaactagctgcactagaattgtttccgccagaaacatctgttttagatagcgctgctagttgtgaattgattgaatttaattcactcttcaaagcactagcttgcttactcatatcagatggagtaatttggcttgaaagttggttcaatccgttagaaacttggctattagcactatagagttgttttgaaccacccgcaatactatcaacagctgacttcatttggccaacgcttgatggtaagtccttagtattattagctaagctagcaataccactttgtaaagtggaagtaccatcagaaactttagtagtgtattcgttgattccactatttaaatcacttgctccagatgaaatttgtttgatgccacctactaattcaccagtattagcatctaatttttggataccactattaagttgataaacaccaccaacatattgaggaactgcaacatttagttgagcagaaccatcttttagttgtgatacgccagtaactaaagcaccactcttagattgtaattcagaaatacctttatttagagcaactgctccgttagtaacttgtcctgaaccattagccaactgtgatacaccagaagatagggcaccagttttgctgttcaactgatctaagccagctgataattgacttgaaccaccagctaattgagctacaccggatgccaaagttccagtcttactgtttaattcatccaagccaccagttaattggcttgaaccatctgctaactgttttacaccagattgcagaggagccacagaaaccgccattgtagcaattccatcgtgtaattgtgatacaccggccgtataagtcttagtaccatcgtttaattgaaccgcgccgtctttaagtttattagcaccatcggccgcgtctttgaaacctttaccagcttttttaacttgatcaaacatagctgtagcataagatttagtaacttgctcccgtacttgagagtttaacttttctgtacctacgtcactaattactttaccaatgtagtttagcgaagcattagtagaatacttcaactgcatctttttaggatttttatctgttacagttgcagcatttgctgagaagttcttagggattgtgactactgtatagtactttttatccttcattccttctttagctttattagctgaaacgaatttccagcctaactggtcatttttcttcagattggaaaccatctcgtccccaactgcgagttttttaccttgatactcaacgggtttatctaagttaaccactgcaactggtaaattttttgtatctccatacggatcccatactgatttcaagaagaaaacactatataggaaaggaatgaaaataattgccagaactgaaattaagattaacttatttttccctataaacttccattctttgcgaatcatccaactagtcccctttaacctttaatttatatatccggatatatgaatcatgatgtacttctaaaagatctatcgcaataacttcttatcttttctcaagatgtcaatcagttcttgaacctgagccaatgcgtctttgatcgtcaattggtaaatattacttgtcccaaccttgcggacggaaaccaaattgaggtcttttaactgcttgatatggtgtgatacggctggttgtgaaagaccaattagcttagttagttcactcaccgtcagccccgcatcactttcgccaagtgtaatcataatttgttgacggcgttcgtcagaaagggcatccaacagtgggatgttcttcttgaacgcagcaagagcagcattgtttttgaccatctttctcctccattcgaatattcgaatatttaaatacaaattagatcttaacgctaaatttaattcaattcaaccttaagattaactttaattatttttcttctagatcagacaataagtccttagccatcttcttggtaagcatagaaataatggcactatgctggagggaaaccaccgccgtttcggctaatagttcgttccacaaattacgcggtccatgttgagaaattcgttggacttcttcgttaaaagcatttacaaaattattgtaagccctccttgaactggtcaacttaagttcagcttcgaaccctcgtttaatttcatctaaactcaaaatgctttttaaacatccaatgatgatgacagcagccagttgcatccgtccgtacagtttaccttgtgggcgaataatgactgcttgcttcagataattatgcatcatcgttggtgttaacaaatcgacttctaatggacgcaaataattattagccaaatcaattacttggtccaaatgaagttcaatatttggtaattcatcccatttgggcaagctcattttggcaaaattttctaattgttttgaatccatttgatctccttcaatcaccttatttaataatttgtacaccaatgccaattaatcctggaccggtatgtactcccaatgcaggtgaaatatctccattataaaattttcccatattagggtatttatttttaaactcagtactaatttgattcattaacccctcattgagaccgtgtaccacagctaaattaaacttttgagcatttttaagggtatcatcaactaattgtagcatttttttaagggcttttttctccccatgtgccttcgccactggataataaattccctcatcatcacatgaaataatcggcttcaaattaataatggaacccaccaagccggcgacacgtccaattcgcccacccgcaattaaatattttaaagttggaacatagaaaaataccttcgtttgattagctacccgctgaacttcctcaacgatctgatcgaactcccagccttcttcaatcacttcacttgctcttactgcagcaaacccactagcaattccaatatttttagtatcaattacctcaatttgaagttgggggtaatttttagcatatattttaacttgctgtgctgttccagacaatcccgaggaaatgcagacagcaataatttgcgtaaagcctcgttttgacaaattgtctagtgcttttgtgattaattcacccttaggactggccgtagttggcaaaggattggacttagccaacttttgataaaattcatctggctcaatatttacacgatcttggtactcttcttccccaaagaagactcccatcggaatcatttcaaaatattcccgattggcaatttcagctggtacatcggaacacgaatcgaccagcaccgctattttttgtttaagcatgctaacttcccctttgttttaaaaactatctatctagttcataaaactagtataacaattccgatgactaacttagctatttaataaatttttcctagtactactagcttcttttcgttacattaaactaacgattggaacaatccggtggtattaaatggtagaatagttttaatatctttcagaatatcgaggtttcatcttgaataaaatcgaattagcaacccaatttatccaacgacacttacaccaatttcagtgtcccatctgtaaatcgaatttcaatgaagttcaatccgggactttaatttgtaataatcagcattcatttaatattgccaaaaaaggaagtctcttctttttaaataatcctgttaacactgaatatactaatgagatgttaacttatcgaaatcagtttttgacggctggttttttcaacccgatgttagaagaagttatcaataatatttcgggagatttaattttagatgcaggttgtggagaaggaactactactaaatggatggcatctcatttcgacggagacttcgtgggtttggatatctctaaaccagcgattaatattgccggctctggaattgctcctcaaccctatcctttatttatggtgggcgatttagctcaattacctttcacagatcaaggtttaacttcaatcgtcaacattttatctccagccaattatcaagaatttgatcgaacgctggcaacccatggtgaattaattaaagtgattcctggaaatcattatctaagtgaacttcgacaactcgtctatcctgatggtgaacatgcgacctatgataatgctccggttaaaaaccattttatcgaacactatgaatacgtcgaattttctaaaatcagctataaatttccgcttgatgacaaattattcacggcccttttcaatatgacacctttaacttggcaagctcaggatcgtaaagaggctattttacaagatggattaaaagaaatcacggcggaatttgaaattggtgtagttcgtaaataataaaaaggcttcaatcaacgttaacgaattgattgaaaccttttttctatattattaatattttaaattttattgtagtttttgaatgtacttggattaagtacttacttattcttgtctatttattttcaaataacatggtcaaacgtacctaaaaaatgtcctaatatcatgaacaatgtctcgcaaagcctgaaaaacaagttttagaatccatcaaacagcactgttatcctgaagtttgcatataacttaagttttaattgaaaaataattgggttaaaacaaaatgaatatcttagctggaatgcagatattcacaaaaacataattaataataccctttgctcctgtacccgaagcaacatcttcaaccttacgctattacttcagcagtgtcaaatttaacgaattaaagtttaaaaggctccaccaccggaaccacctccaaaaccaccagaactacctccactaaatccgccggacgaaccactggaactagctgatactgagtgtgaaatagaagtactaatactgttagcaatacctgcatgcattccattgattccataatagtaggcataaaatggaacattttcgtttaattgagttccaaaatccgtctttagttttttagcaaccttttctgccaacccaaaagcggtggcatatggcaaaatttgttcccaaagaattaagtcaccaatctccgccgtattaaaatgagcaatatccttcatcatctgtttaaatcctcggatttgattatattgctgcaatccagcctcgttatacattgaaaccttatcccaagtagctaaaacccaagcttcaattatcaacgttaagactattccgcctatccagtacaagttagttacttccccaaatcttccgataattcctactatgaaagcaaggattggagtagtaattgctagcccaagcagtccatgacgataactaatattatacgtatctttaaagcgggctaaattggtatcaacctcaaactgccactccttgtaccatgtagctacattattcttcttatcttttttagcataatcattaatttgcttgatagtaacttgttgaccatcaccaatgcggtccaagcagcgatcgacaaaggacatgttgaatttaccttgtcgctcaatttcagtggtttccttacctcgcttgccatagggaatctgtttgaacttcaatttaccttcagccgccaaaactaacatttcagcagaaacacccttagtatcagctttactcttgttaaatagcgcttctgcctctgctggtgaaatgctcgggacgtcaaaactatgttccatgggcgtcgggatatcatattgatgatatccatgtttttttaaccaacccatcataccgattaaaatcagtacacttatgatggcactggtaattttagcataagccgcaatgcgtcgagctcttgcttgggcttcattttcacgctttaccagttgatattcctgtttttttactgctgctagatgattttgattaacaatttttttattatcgggagttaaagccgtgggaaataccatatgtgcttccacaaaagtgttctctggattgtctcctatatctaaagttactttacctttagctttatccaccgtagtgtagcctgcagcctccccatgagaccaagcatgaagtcctttaacattctttccaggtaatttaatggtaacttgcgcatcctctaagggtacgtcccaacccgatccaattactttccaattaatttcagctgtatctttgtagttggtcaccaccccgttaatccgataatggtacgtaattttggtttggtcatcacttgatacagcattataaaccttaattttcatttgctttttacttgattcaactttagcagttaaattttcaccgctgttattaataggaacttggttttgggctcccttgttattagaaacggtaatcccctctaattctgctcccgcggttcctcttaaatcttgagtcaaataaactccatgataatcatcatcaaagtcgtacaaaacactttgattgatgttggcgctcccatccttatttacattaatctgcattctaaattgtgaaatttcgtaatccgccttaactgtcttaacattccaaaaaataccgaaggttagcatcgtgactaacaataggaacgttctgttcgtaaaaaatttcatattactcccccaaaaattgttcaataatccccgttaaatgttagtcaaagtatagcatacgtgagcaggtgcggacgatggtagaatctgtttcagagttgataaaaatgcttttctaagtccttcgatatttatatctcggctacctttcataccgacgtatcaacgataacgttatgactaccgcattaattaacgttgttaaagctgtcacaccagcgattatcgaaaacgttgcaaagcacattgatgtaaaataccccatcaatgtaacgacgatgaaagcaacgactacataattttctaactttagcgtagttttgttgtaataacttgcaataacaattccgatataaaatagcgctatccccacatacagacacgtaatcgaaaatatagcattagcttcagattcatggataaaatccaaggccaccgtgactaaactcaagccaaacaaaataaagtaatgtaaatatattagtaaatttccagtttcatgggtacgctgttcttcaattaaatgatcaaactccacaatatacgtaaaaaatagactaactacaattataaaaatcattatggattgaattgaaaatgtattttgcgtgaaatattttgaaatacctacgatggtttcaccgaacataataataatcaaggccgttagtcgtcctaataaatgagagaaaataatggggtgcttttgagtatgtttcccggtaaaagcgggtataatccaactagtgataattccaaacaaggcaattgtcgtcccccatctgccagccaacactccccccgctaacaaacaagccattctaaaaaataaaattctcataaaagccatcgcaatgtttcggtcatactcatttttagtttgtacaaaaactagtaaatattgaattgccaaagttagtgataaaagccctgctgctataaagaagccaattaagtgtcggtcaaacgtgtcggaaaaagcattcgacatataaagtgcaatcgccatatcgacaaaagataaaattacattagaccattgggacttcccatagcgattattaaaaaccgtctgaaccatccacgaattgatcgaaacgattacaactaaagtaaagatacttagtgcacttgggctaattacaccattttgtagatgatggattaaccctgttacttgtgaaatcatatatacaaaaactaaatcgtagaaaagttcgatcatcgaaactttttttaacagctcatttttcacaaaaatcaccttcattatctagagtctttatggatatcatagcaaatttacccccgtaaatttagttaatttatttttttaaatgtaagcattttatttgagctatatcaataaaacctttaatatctgaaccacaaaaggagggattgtataatgtttaaacatcaaaaggaactacagtttgaagcaaaaccagatcgcccagatccaatcgttgctaagtaccttcaagaattaattgggggacaatatggtgaaatgagtgtggccatgcaatatcttttccaaggctggagttgccgaggagaagaaaagtataaagatatgataatggatatcgccactgaagaaattggccacgtcgaaatgttggctaccatggtggcacgacttttagaagatgctcccatcgccgaccaacaagctgctatgcaagcgaatcccacagttggagccatcatctctggaatgaacccccaacatgctattgttgccgttttaggccctcgccctgctgacagcgttggtaacccttggagtggtgcctacattattgctagtggtaacctacttgccgattttcgtgctaacctcaatgctgaatcccaaggtcgactccaagttgctcgaatctatgagatgattgacgaccaaggtgttaaagacttactttctgtcctactagctcgtgacagttatcaccaaaatctctgggctagtgcggttaaagaactcgaagaaaaagaggattcaatgttagtaccgacgactttccctcgggataaagaacgtaaagacattgcttacgatttctacaacttctctcaaggagatgaaagtagtaccgggccatgggccagtggagaggctttggatggcgaaggtgaataccactggtatgacgaaccaaaagtagaaggttcggctcctaatctaaaacccgtttctcctaaaatgtatggaacccctgaaaataaatcaaaaatttaaataagcgaaaagcgaaaaaatcataactgattttttcgctttttttaagcttttattttaattttcttggggttgcgaaatagtaaccttgctgtttttctaaaccattttctaagagccatttactaacttcaagactatcaatcccttcaattacaagatcaattccagtatttgcagctagtgctttccataaagaaattgtaactgtaatcatcccttcttctacatttcgtagttgaattagtgatagcttgagacgatcaatatcctgcgtgtattcacgaacggcattaaaactattcattccactacaaacatcatcaactgcaacactgaagcccatttcatggattctcttaatttgatctcgtacagaataattgaaatattggtcaatatcacggttactagggatactttccgtaacttcaatcatcacccgatcacaataaggaattaaacctttcattgcttcaaacgtagaatcatataatagttgctgcgggtcgaggttaaagctatattggataccaggattatcgttaataatctcaatgatgtttttaactaaccatgtacaaaaaactaaatttgatgcatcatcacgcatgtattccttatatagcattgcggggaaacgattctctccaccagtttttctaagtagtaattcgctcccgatgacctttttttcttccttttcggccgcatctatcaaaaaaatcggttgttcatagaagcaaattccttctaatttttgttcaagttcgctcaatttagcgaggccacctttccctcaaccgtaatactattacgtttgtttctcttagattgatacaaataatcatccacacgtttgtagaatgtttggaaatcaaaatcatcatctcttaattgagaaataccgattgaaactttaattccaactcgatcatgattgttaaccctaattgtttcttttaccaaatcatcgcggatggctcttacaattttttcacaatcatccgcagtacggcctcgaaaaataatggcgaattcttccccgccaacccggaatagttggccatgagctttacgatctacaagttcatatgaaaaacgatccgcaaccaaccttaaaactttatctccaacttgatgaccgtattggtcattaaattgtttaaaatgatcaatatcaaacattaccatggttaatggcgcatcattattagaataaaattcgaatacgccttccacaaccttattgaagctattacggttataaactcctgttaacgcatcagtatctacttcctgcatcaagtttaaatactgcttcatgatcattctgacttttttgttaccaaaatggacgattgacattgcgattaaaaattccaaggtcaagcacataatatcgacgatagttagatgatgaatatccttaagtacaaaccaccaagctaatccaaacataattaacgtactgtaatatttaacattctcatcaatcaaagtgtcattttgctggtagattgtgtatgaaattaagataattaccaagattgctaaaataggagcaatatcaaatcctatttgtccacgtactatccctaacccgtatacatacatgggtaaaataatattaaaccacagtacgacttttctatgaacaatatataggcagtagaatagcaccacaaactgagcagttgagtattcccaacctaactcactactagcaattgttgagtacaaatgagtaaacacgttttgtaagaaaaccatcgcgattgttagaccaacaccccatagtagttcttcaatgagtgttgaacttgtttttgttttatccatattcatctcaactacgtaggtacctgcagctaacatgaataatactccgaccgtaattgccgcaataactaccgtattaaaactaaaaaaaacttttgcccaatatatgattgtattcattacagtattttccataagtttttcctttactactccatatcccctattctctgaacaatttactattcctcaaaaataggtatacttttaacactgaagtccttttcttgttaagtaatgctcaaaattgtttaaatcaactttcaattttgtattttccaccccgttttttgtatggacttggatatttaaacgactgcaatgcaatttcatccaagtatttcagatgaaaacaagaacgacataacaccatctagtgcattcgtccttgcctcattacatttcataaaatcattaccctttggactaaataatagacttgaatacgctatctatatctccaaagcaaacggaatttcatttttcgtagcttataaaagaatagcatatccatttttggaaaacaatccaacaagggtgtttaaaatttgtacatacatctttttatatagcatacaactttttaagtgtataaaaaatatctattatcattaataattaattttaaatattatgatttccaatcagaacgatgtttcttatatttatccccaaaaaaatcctttcttcatctctgccctaagttgtaatctgactaggcgatatatatactaaaatattactagcgtttaattacttaaattaaacttttagcttaattttaagtgattacctcaaaggagaacaaattaattatggaatcaacatcttttgttaataatccagaaatccaaaaacgtcggtggtggattttaattgccgtatgtagttttactttcatgtcgactttagatggtagcattgttaatattgcattgccggtcatgagtagtactatgcatgttcctatgaataaggctgaatgggtcgtttccatttacctcattgttatctgtactctcttactcttatttggaaaattgggtgacgctcatggaaaaatacgggtctttaaaattggtaccatgttatttaccataggatcacttctatgcggatttaatactggtttaacattcctattgattgctcgcattattcaagctgtaggggccgctatgacgatgagcactaataatggcatcattactgaagttttccccgcccaagagcgtggccgggctttaggaatgattggttcatttgtcgcccttggtagtattgctgggcctggaattgggggattaattctagcccattttaactgggggtatattttctggatcaacgttcccattggattattagccattttagttggtcataaaattcttcccaaagatgtaattatgactcatcaaaaaatcgacaaacctggtacgatcttatttgccatcacgatgattaccctattcgttggtatttctatgggacaggaagtcggttttacccagccactgattctaacaatgttgttcgttgccttaatcgccttgggcacttttttatatgtggaattacacgttgaaacacccattttagctttatatattttcaaaaatatgcgttttaccctcagtattatctgtgccttcttaattttcattactggatttttctttaacgttatttctccatttcacttagagaatacacttggtttgcctgctaattatgctggatataccttgatgatttatccactgatcaatgttgtgacagcgccagtagccggtgctatttcagataaaatcggatctgaaaaattaacttttgttggattactcattattttaaccgctcaattaggctacatcgtcactaatttggcaactcctttatggcttttcatgatttttatcggtttaaacgggttgggaaatggtattttccaagctcccaacaatgcacttgtaatgggctccgttgaacctaaagacttgggcattgctggtggaattaattcattagctcgaaatctcggaatggttgttggaatttcgtttgcaaccactgtattattttccgcaatgagccatatcgctggacatagtgttacttcagttgtaccggggcatcctgaaatttttattgctggaatgcatgtagcttttaccgtttcctttggtgtttgtttaattgctaccctaatcaccggatatcgtttgttgcggcgtcaaaaataaaaaactggaagcattttaggttggttaatttcacctagatgctccagcttttttattttgtagtagtagatgatgttgttgtacttgtcttagtcaatgtcactactgttgttttatacttgccatcacgataatagcccaccgtgattttatcattaatcttgtgcttgtatagtgcctcacgaagtccggctgtatcagtaattgccttatcatcaatcttagtaataacatcgtatttcttcaaacctgctgttttggctggaccattattaacttgcatcaatacggttccgtccgttacattagaaggtagtttaaggattgatttttgctgtgtagatgaaacttgggttaaatcgactaaagcgacacccagcgcaggacgtgtgattttaccattcttaaccagttgatcaataatggttactacttcatttgaaggaattgcaaatcccattccctctactgtagtagaatcactcccactagcagagagtttcatcgaattaattccgattacttggccagctaagttaattagtgggccgccagaatttccggcattgatggctgcatccgtctgaataacagttgcttctccattattctgtccattttcagtggtagtttccaccgttcgtttcttagccgaaataattccttgggttagtgaggtggcatattctgatcctaatggtgatccaattgccaaggctgtttcaccaactttaatgttatcggaattaccaaagctagcaacggtggtaactgctgatgaattaatcttcaacacggccaaatccgttacactatctgttcccacaatcttagcaggaagttttttaccattgctcataataatctcaagtgaacttgaaccacttactacatggttattcgttacaatataggctgtgtcaccactctttttatagataactccagatccttctgaggcggtctctaattctgaagagctacttgatgatttgctagaagaactcgattcgtttccaaaaattgagctaatgatactgtcagaatcattagtattagccttttgtaggttaatcactgaaaccactgaatccttaattgtagagaatgctttggatgattgactacttacgttaactttaacattactagtcttggttgttcctgtggtatttgagcccgttggtactgctgtactagatgattccatctggttatgaatgaagctcgccccaccataagcaacacccccacccagtaggcccgcaatggctgcaacaatgactaatttgtttgttttcataagaatgcgcggatttcccgctcccccctcatacaaaatttattttaaatttattgtacatggtaaatacgatggttatgtgaatttagtcctcaaaaatttgaaatttttattaaattaaagttaagggatccgcaatttcgtggtcagtatctaaaatttcgaaatcgtgtccaaccgctaaatcgtgattttgcatcatggaagatactgttagatgcgctaattctttcatattattatggaggcttaaatgacctaagtagatttttttagttcgattaccaatcacgtccattagagcgttggcaccatcttcattagacaaatgcccgtggtcccccataattctttgtttcaaaggccatggataaccacccattcgtagcatctcagtatcatgattaacttcaaaaagataaccatctgcgttcctaatagttccagcaattcgatcagaaacataacccgtatctgttaaaattacaaatgatttacccgcatggtggaattcataaaactgaggttcagctgcatcatgtgaaactgaaaaactttcaatatcgaggtcatctagagacttagtagtattaggatcaaaaatgaatttttgctcagttggaactttgccaattttaccaccgatggcatcccaagttccttggttagcatagatatcaattccatattttcgagctaatactcccacactttggatatgatccgaatgttcatgggtaacaaaaagtgaatcaacttcgctaatatcgcatccgacgctgtccattaaacctgcgatttttttaccacttagtccagcatccaccaagacttttcgttctggcgtttcaatatatgttacatttcccgtactgccacttgcgagtacgctaactttcaaaccatcttcgctcatttctagaccttcctacttaatttaacttaaattgatgcaaaaattgaacttcaaatgaagttcgtaaccgacttaatatgtggtgctcgtactagttgtagcttctaccccagcttctgtcgttgctgaactggttgagctggttgtactagatacatcactactagcactcgttgcctccgactcagaagttcccgtgcttgaaacactactgctatcatcactcgctgcggtactaccactcgcttgcgtcgaggactctgtggttacttcatggtcctttttaatcaagacccctgaaaaagcattaattcttttcacttgaataccagtgctactcttactcttaattccgattacccatgtcggaacatatactactccgttatcggtggtaagtaaatttgtataacctaaatcggcccattccaccttggaatcattttgaatttcattatattgatatagccacgttactgctcgagtttgactaatcagttcgctcttttctcgcagttgtttctcatttaccaaatgtccttgcgtataaccagtaacttcattgctagcattaacataaaaagttagctttccagccttggaatagacggggtgtccatcaatcatctgcgtataaactacttggacactggtacttaaattagggttgtactggtattcagagccataaacgatgttgtagcgattcttgacgaatgtattaagtactttttgcggttgtttaggatcgaccgtaagttcctcattcaaagtactttcaacgtaattatcaactactcgtgcgctttggtcagtgagacgtttgatattatcctttaaagatgtgtcgactgtcgcacttgcatagtaaccgttcatttttttatttgaaagaggcatataagtaatctggtcgtttctcatttccttcagtatcgtcgaattttcgcttgaattcgacgatgaagtcgtcccagcttctaattgatattgccagtaggaaccaaataaataggcattcaaaatagcgaatacaacaataaagatgacttcgattcttctgaaatccattttgttcctccttagctaactaaatcgcgatatgacgtccagtcgccatggtacttaataaaccaggttggttcaagttcaaccgttgaattagctttagttgtacttggacgttcatatccaatatcaatgtcttcaattttatcagtattaattccgctatattttaattcatccaacatatcttgcgtacttggtagctccttgtcactctttgatgtgggaactggaacgtcaagattatagattgaaaatgaggtcgtggtttgttttgcttggtgagcgactttaatcgtatccagaccgtctgcattgaagatcgggaagccttctacaaaatctctaaattcgatttcatgattattttcatggaaattgaaatagcgcatgttgcccacttgtacccctagttgtttcatctgataaaaactcaactctagatttcgctttaagctttcttcagtatcattagctttgctggcattattaaatgtcacaaaaccattgtttttaatcagcaaacgtttggttgtatcatttgagacatattctgtaccatctttagttttcttcgtatcaattgaatctgcatcagtatttgttaacaagttggcagtgaagacgctactgctctctttattaactgaaaaactataataaggtaccttaattgcagtttgataatcattaatcagattatgattcatgatggtttctttcactttatactgactatcactctgcttaatcaatttgcgtaactgctttaaatcttgtttagaagctttagcttggtaaacgtcataagccgcatcatttaacaggaaaaactcgtttggcttattcacgttaactacaatttggctaatttcagcgtttgtatttaacttttgatcataaatactattgaaaattttcccagtgatattacttggatatttcagcatcaaactgtgacttaacgtagcataatccaaaaaacgttctttattacctcttgaaacccgagttatgtttgataatttccaactcgaaatttctttaacagctgccttgggaaggctacttttagaattattaatcaattcttgttgttctcccttggtatagataacctgcgttggtaagataacatcgcctttatcccgattaacctggtttgattgtactttttcactggaaacctgcttagcgcgttcataccgagccgggttagtccaaattacccatgaaagcacgatgctagttaacgctaatattaataaaatgacatgtcggacaattttacgcgttttagtatctttcattattcccaagtatctccttcctcaaagggttcatatggaagtgaaatgtagaaggtagatccttcaccttcgcgactttcgacccaaattcgaccaccatgaagttggataacttcttttgaaatcgccaatcccaaaccagtaccaccttgagcccgtgaacgagccttatccacgcggtaaaaacgatcgaaaatatggctgattgaatcctttggaattcccaaaccttgatctgtaatactcataatcacgtgattgtgggtctctaatagccgacaggtaataatccctccatctggagaatatttaatcgcattattcatgatattatccaatacttgttgaattttatctgtatcaacttcaacccaaatatcacgacgcgtaaagtcgcgtttaatagagtaatttttatctggtttatcactatttttcagaatcatatcgaaacggtccaaaatatggttgaataattcatttaggttaacatattcacgttccaatctagccgttcctaaatccatacgtgataaatttagtaaatcattaatcatccgcatcattcgatccgtttcttcttgcgtaaccttcaagaaattaggggccacttctggatctttccaggctccttcaaccaatgcttcaatataactcttcatactagtcaaaggggtccgcaattcatgcgaaacgttagaaacaaatcgttttcggtcttgatcaattttttgctgttcagtaacatcatgtaaaacacaaaccagaccactaataaagcctgattcacgctgaattaaggcaaatgaagcatgtaaaattaaatcttggtcatcatcggaaagatctaaaacaacctgctcttgattttcaagtaagtcccgtaaagtaaatgttcctcgtaaatcgagaatgtctaaaattgatttcccaacgatttggtcattttcaagattcaagaaatccgttgccatttcattaacgatagttattcgtccgcgtcgatctgtcgccagcaccccatcagtcatatagcccaagacggaatcaagacgccgccgttcagattcagtcgattcctgagattcttctacccgtacagaaagttcattaacagcttctgctagttggccaagttcatcatcaccataaatctgaacctgaccagaataatctccacgggcgatttgaatcgttcgttgccgcatttcttcgataggacgggtaatcgctcgggaaattaaaacggctaaaattagtccaattgtaatcgcaattaaagcagctactacgaaaattaacgtaatattattaacattttgatataccgattctagattagcgcgtatataaacaacacccgtcaagttgttggttgctcctgcagtgttaattaaaggaacaattgaaacaaaataacgcgtgttagtggttttattgtacgaaacttgttgataggttcgcgtattgtagattacatccttaacattgcgatccgttgtcttttgaccaacaatattctggttagtactattactcgttccccgaataacacccttggcatcaatcactcgaatttccgtgatattttgattattgatgtttccaatgatatcggatatttgtgagttagcgctcttcgtattagcacgttctaattgtgtactaatctcattttcaacataaggttgtagttgaacttgagtcttaaattgattcaagttttgtgtttcaagttgtcgcacaaaaataactccaacgacttccaacgttacgactagcaacattgcaaacactagagctattttaaagttaattgatttgaaaaaattcgttcgtttattcatttagtctccaaaaatcctgaattaattaatcattttctggattacgtaaatagtatcccactccacgacgtgtaaccaaaatttgagggtttcctggggtttcttcaattttttcgcgcaaacgacgtacggtaacatccactgtacgaacgtccccaaaataatcatatccccaaaccgtttgaagaagatgttcacgagtcatcacttggcccgtgtgttgagccaaataatgtaaaagttcaaattcacgatgggtcaaatctaattgcatcccatcacgagtcactgagtatgaatctgaattaatcactaaaggtccaattttaatattatttttaacagtctcatcatcttgctgcaattgatcctgacgacgaaggttggcttttacccgcgccactagttcacggttagaaaatggcttagtaacgtaatcatctgcaccaagctcaagtccaacaaccttgtctaattctgaatccttagctgttaccatgatgattggaatattatgttttgctcttacttggcgcgcaacctctaatccatcaatttttggtaacatcaaatcaagcagaatcaagtcgggcttttcttcttcgacttgggcaagagcttcctcaccatcatatgcagtaactacatcgtatccttctttatctaaattaaacttaactatgtcagaaatcggtttttcatcatctactactaaaatctttggcatgttagccctccttggaagatttatctgccatcaggtatgcattcctgataaaaatggtccaatccattaatcttggttaattataacatatacactaaaatcaatcggaaacgctatctgtagcacgatttaaatcgtttttgcatttttttaatttttttcgaaatttttttaaaaaaagtattgccagcccctatttttcatgatactatatttaagtcgagttgatacatattaattatatgggtggttagctcagctggcagagcaacggactcttaatccgtgggtccagggttcgatcccctgaccacccatcaaacacacgacacactaatcagtagtcacgcagcgtaaagccgtggttactgatttttttgtgcactaaaaaacagtggataaccttttccactgtttttttcatacctatttttccacttttaatacgtactagctacctgcttactaattacccatcgcccattgttcttctcaaaatacattttcatttgaagaggccaaacgttcttcgatccgccccagattttggcggttactaaattttggcccgttaattgtcccaaatttccttcaactcgaatatctttgatagcttcttctttggactccaagtactgcatttcttcattttgtatctgatcgatccattccagtttaggttgcacgtatcccgtcatatgcgttaaagtcattcgatcgcctaaaatcatatctagtcgacttatatcttttttcaccattgcttcattttcagctcggtatagttgaacaatttgttcttcatcttttgtcatagatttactcctttgatatctttctatcctatatggtatctataattaagaagccgagctattctaatcttaaccctattaaataagtaaaacttatttaaaatgatgctcaaacatttcggcaaaagtttcaatataaaaccctgaattatcgactttccagtacatataatatttctgagtcaattcatgaccaccattgtgcaaaggtacggtttgaatgattccactatcgagtaggttttgggttcgctgattaacaattaaatatccttgattagctgcaatcagcatctgggcttcatcgtagttagcaactaatcgaaagccacctttaacacctaaaatttcttgataatatgtttcctctgccagttgttgctttgaatcggtaattaaaatacatggcaagtcagctaaatcagccacatcaatttgctctgcgtggctaaattcccccgtttgacttactgcaaccatcaatccactttctgtcaaaaaatcatttacatattcattggaaggggctcgccgttgatcagaaaaagccagatcaattttttcttcacgcaaccaatcatacaattgttcatgcgttccattattgattttaatttttacttctgggtaagatttagaaaattcagcaacggtttgtaagaactccgttgttccaaaacttttcaaatatccaactcttaattcaggttcgttatcattggcaattctaacagtatctttaacaatttttttaacctgtcctaaaacatccctactatgctgataaaagtactgtccagctggggtaatttcgaagctccgaccctgacgctttaacaataaaactcctagattattttcaagttctttaatttgttgggaaatagccgattgagaaatattatcgtcaacagctgcttgggtaaaactgtgtgcatcgaccacatcaataaaatattgcatttgttgaaacattagtttacctcacttcatggatttacctcattataaaacaaaaagagctgaaacaaatttcaactcttccttaaatataatcattgaggggtgttaattccaacactatcccgtgaatacaaggtagcatccaaagtgagtcgttttacaagatcagcaattgaactaaccgaaacatcatgtcctccgaacggttctccttttaatgtaacttcgtaatctactggaccactagtaaaccaacctggacgaattacggtgtaattcaaatctgaagcttcaacaacatcagctgcttgtcgatatgaacttaggaccgaattatattctaaattcccattgcttccaattgttgctggaatctcattatagattcccatcgaggtaataaatagcaagcggtcaatctgattacgtttcattgctgatacaatattttcagcatatgttcctaaattaccactaagcgctacaaatacgacgtcttgctttttcatcgcctggtctaaatcatgggcttggtttacatcaccagccaccactttttcacgactaccggtttttaatcggttggcacttcgagcaaaaagggttaaatttgcatctgtttcacttggtaaagtttgtcttactgcatttccaatcgttcctgttgcgccaataattaatacgttcatgataatccctctctttataaaatcacttattttttaagaccgatatttaaagtagctccgactgaaatcaacataaatacggccataatgatgatagcgtggtcatatgataatactgggctaattaaattagctgtcagcgcggtgataattgaaagtcccactgaactaccaatttgatgaaccatgtttactacacctgaagctgatccggcaatttccctatccgtatttgctactccgactacggttagagggctcaaggtaaatccttgaccgataccaataatcaccattggaatagctactgaccaccaatatcctgcttgtatgcctaccacagcggcgaaaaccaatccagctaaggtaattaccgttccagcaattaaaatctgagtattagtaaacttttcgtttaaccgtgataccaatgtagcaaaaacaaattgaggtagtgtttctggtaagaatcctaccgctgccattaatggcgtaaagtgataaacctgttgcatcgcttgtggcgttaagaagaagtatgaaatcattgcacctaagaaaaagaaccttgcaatataagcactacttctttttcgatctttaaatagttttaatggtgtaatcgggtgcttagaaactttttcttgccatacaaataaaaccaaaagtaaaatcccggtcataaccattggtaccggatgactagctccattaattccataaacaagcgcagtaattcctaagactgacaaaattgaacctaaccaatctaattttccttctacctttttacttgctggaatatatttgagtgttaacacaatcatcagtatccctacaggcacgttaagtaagaatccccagcgccaactagcgtaactagcaatcaatccaccaacaactaatccaatgctggcacctaatccaccagtagcaccataatatacaatcgctctggttctcatctgatctcgataactatccattaacaaagctaaagtggttggagcaagaattgccgatccaattccttgtaaggctcgcatggcgataatcattgaaccattagttgataaaccaactaataaggatcctatactaaagattaccaacccgattaaaaagacatttcttcgaccaaaaatatctcctgaccgtccaccaatcattaataatccaccaaaggttaatgcatatgcattagttacccacgataattccgaagccgacaaactcaagtctgctgcaatctttactgtacttgtaaaaacaattgaattatccaaaagaatcataaaataactaattaaaataattggtaaaaccataccaaatttctgcttgttcattcctatcacccgcatccaaatttttattatgtaattattctacaagctcccccattcctaaccaatttcgattcttgccgcttttcataagtttttcttatggataatcagggttatcccatgtaaacctgaaacccattaccatacaaaaaaccactactatatggaaaattgcattccatcctagtagcggtccataaaccaagaacaatctatcaattattcaatttcaccacggagtacccgatcaatcatgtccattactccactatcgttgttatccaacggtgtaaccaattcggttgcgtccagtgcttcttgttctgcatttttcatcgcatagcctagtcgcgcatgatgcaacatggcttcgtcattttgggtatcaccaaaagccatcgtttcatccatcgaaactttccaacgattttgtaattgctgaagtccatacgctttagtaacatggggcatcgtaatgtcgattccattgaaaccgctcatcacacttcccaagctatctcctaaggcgttttttaacagtgcggcttgttcacgcacattatcaatatcaacccaatgggcatcaatcttataaattggatctttaatgtccttaaagtgatccactggggttaattggctgtaaaaatacgagctaacgggccattccggattatccattttcatattagtaaatgcacgatgttggctcgacagaatcagctcaacgcctttaaacatcggagtcgtcaataagtactcaattgtgtcgtgtaataaagccggttttagcggattatcgtctaaaattttcccttgttcaatcgtaagggcaccatcttcagcaacaaaggttaaatcccccttaatgccagcaaatacttcctgacaatgagccatctgatttccactcgctactacaaatttaatttttcgttcattaagtttgtctaactgagcttgaaaacgttgatggtcaaaatcctgttgatcatttagaaaagttccgtcgatatcacttgcaattaattgaatacccatggtggcctcctacatattaacttttttacaaattattttttactagggttaattggtttttcaacctttttaccaacttccattttgtcattgtagccccaaacataagctgcaataaaggcaataatggtagatacaactgaggaaatcaagaaaatccagaagctgcttaaatcagacggattgcttggattaaagaaggatgcaaaaccaatccatgaaccggcaaatccgtacatattaccatggaacaacccggttataaatccaccaaatgctgaaccaatcaatccagaaatgaagacccttctatagcggaggttaaccccgtaaatagcgggttcggtaactccacaaaaggctgaaatggcagccgcaaatgataaactctttaagttagttttcttagtcttaatcgccacggctaaaacagctgcaccttgtgaaatcatggtttggcaaatcaaagcatttaagtaactgtgtcccgtggtagctatgtcattaactaccaatggagtaattccccaatgcaagccaaagattaccaatacttgatggaaaccacctactagaattcctgatgcccatccactatgaaccagtacccatgaaatcattaccgcaatccatttagaaatgccgacaatgactgggccagtaatataaatcgtaattccactaacaatcagaattgtaataaatggaacaaaaatcatggttagataacttggtaaatgtttcttcaaataattttcaattttaaatgccaaccaagcagctaaaatcatcgggaaaatcgagtatgaatattggaccattgggaagttaaatccacccaacatccctaacgattttccagccaacggagttagcgtagggtgtaccaataccccaccaattacggctgcgatgattggatctccaccaatgcgttttgccgcagaaaatcctactaaaattgggaggaagaagaaaactgaatcgccaatggcatttaatatgatgtataaattacttttaggacttagtagttccccaatctgtggcatcgttaagactgataataatcccttgagaataccagctgccgccaatgaccaaatcactgggctcatcgaaccagtaattacaccaataaagttattaaaaccatcttttgctttttccaagaaattccggttatcaggtccttgtggttgcgtagctttaacagcttgttcggttccttcttcatccccaaattctgtccctaattggtcaataactgcgtcataaacatcgactacatctggaccaatcactacttggtattgaccttgagcacgcataatatcaataacatggtcgtcatttcgaataatatcatcgtcgggtttattaatatccttcaaataaaagcgtaaacgagagatacagtgaatcacactattgatattgtcgggtccgcccactgcatcaattgctttttgagctgttttttcaaagcgattaccttcattacttttagaacgctccactttttctgaaaccgtttttaattttagatttgcaacattttttcctacttcaactgtatcagcttcaatttccaactgctctaacacttcactgctattagtgattgcaaagattatagtagtttgcttgccattattgcgcactaaatctaagtcccaagttcctaggctacttcctgcttctacatgatcgccaacttgaactttaagatcatatggggtgccctttaattctacggtatcaattccgagatgtagcaatatttcgacaccactatcagttttaataccaattgcgtgcttactatcagctaccatcattactgtcccagccacaggagcaactagattaccgttagtaggttctaacccaaaaccttcccccatcattttttgggcaaaaacttggtcttctacttgttcaagtggaatcaccttaccacttgctggtgctacaactatgagattatcatttgtttttttcataagattattcctcacatgctctaatataatttcaatatatttgtaagcgcttgctatttaacatgcttttatcataaacttgtatatacaagatgtcaacaataaagatagcgcctttaattacaggttattgataaataataaattatattaccttgtatatactagttacatcatgttaaaatgtaagcgtttctaagaaaggggtagctcttgtatggaaagtaaatatgatttaataaaacaagatatcgccaataaaattattcatggtatctatcctgccagttcttatttacctagtgaaaacgaactttgcgacctatatggaacttcacgtgaaactgttcgaaaagctttggtgctcttgctagaactgggctacattcaaaaaattaaaggcaaaggatcaatcgtcctcgatgtttctagatttgttttcccagtttccggtatcaaatcgttcaaagagctcaatcaatcacaaaatatgcattcaactacaaaagtacttacattagagcctcgtttggtgcctaccaaggattttggtctcgatcaaaatagtgagttagaagctacttatattgaacgtttaagaaccattaatgatgaacccatcattattgatatagattacgtactctcaaaggtggttaatgatattccaaaaatggctgctgaaaattctctgtatgaatatttcgaagaccaacttggactggatattagctatgctactaaaaccatcacggttgaagagcctactgaacgccaacgtcaattattaaaaattccaccacacaaagacgtcgtagtaattcgaagtatgacttatctcaatgacaccacgttgttccaatttaccgaatctattcatcgagctgataaatttagttttgttgatttcgctagaagacaaaaattgaaaggacactaactatgaattttaaaaataaggttatttaccaaatttatcccaaatcattctatgattccaacaacgatggcattggagatttacaaggaattatcaaaaaaattccttatattgataagttgaatatcgatatgatttggttcaatccttttttcgtttctcctcaatacgataatggttatgacattgccaatttctatgaaattgaccctgtctttggtacgatgtcagattttgaagaattagtccgtaaattaaaggaaatccatgtcggagttatgctagatatggtgttaaatcatatttctactgagcatgaatggtttcaaaaagccttagctggcgacgaacactatcaaaaatacttctacattcgagatcctaaaccaaatggtgatttacccaacaattggacttctaaatttggtggaccagcttgggctaaatttggtgataccggtaaatatttcttacacttatacgacgagcatcaagccgatcttgactggcataaccctgaagttcgccaagaaattttcaaggtcattaatttttggcatgccaagggggttaagggattccgctttgatgtaattaatgtgactggaaaggacgtagagttaaccgacgctcctgagggcgtagaatcaaaatttatgtataccgatacacctatcgttcaaagttatcttaaggaaatgcatcaagctgcacttcaagaccctgaagtaattaccgtaggagagttttcttcagcttcagttgaaaatggtgtgaaatatactcgtccggaagaacatgaattaacaatggctttcaccttccaccatttaaaagtagattacgaccacggacaaaaatggacgaaagttccttttgactttgctgcacttaaaaagacgataaatacttggcaagtgggcatggatgaaggtgatggatggaacgccctcttctggaataatcacgatcagccttgggccttaaatcgctttggagattctggtaaataccgagctaagtctgccgaaatgctcgccaccacgatgcatttacttcgtggaacgccctatatttatcagggagaagaaatcggcatggttgatccagattaccaaaacattgacgaatatgttgatgtagaagccttaaacgcttatcaacgactcttgaaagaaaataaatctcctcaagatgcacttgaaatcgtgaagtctaaggctcgcgataatagtcgagttcctatgcattgggatgattccaaatatgctggcttttctgaagttcaaccttggttaaaaccaactaagcaaactgaaatcaacgttgcaaatgaactagaacacggtgaaatttttgcttattaccaaaaattaattcgacttcgccgagaattctccattatttctgaaggagattatcaatcctttgaacttaatcacccttctgtattcgcttatattcgtacctatcaagaccaaagcttgttggttctcaataacttctatggaaatgatgctaccatctcaattcctagtaaatacacaactgaaactgctaaaatcttgattaacaactacgagactaatcctgaattaacaacaacgctgaaattgaaaccttatcaatccatagcaattctgatttagtgcaataaaataagtccttcaagttaactaagtagcttgaaggacttttattatctagcattaattttaatttcatgtttatacttgcaccgataaatatttaaagtagtttctcaaataatctgaagtggccagtccatcttcgtatagtgtaattcgatagccatcggcatttaacgtgaaagtgttacctccgataaattgcccctcagcaacgtatcctatatcgtctaaattgaacttcattcttgttattcctaaaccatttgaaaaagttaagatcattttttcatcgttaaacttaacttgagcatatccaatctctctggtaccttctgaagtcacttctacatacgtatacatatcaatcatcctcctttaaacagagcataatctatgaaacgcgtaccatagcaagccttaagattgctaagttaaaatattggttgtggaacgcgtttcatactttaaaatgagggtatggaccttaatcgaatttaaaataggacttgataataatgactaatattagaaccattgctaaaaaatctggatactcagcatctaccgtttcccgttttatcaatcagagtggttatgtttctgataaagctagtaaggagatcaaacggattattgacgaaatggactacgtacccaatgccattgctcgtgacctgagtaagggccagacgtttacgattggtgtggtagtacctcatatgcgtcatccctttttttctgagttaacccatggaattatggacttagcttttgctgctgaatataatgttctttttttggaatctcagtatgacgaaaagttagaacaaaaatatttagaaaaacttcaccgaaaagcctttgatgcgctaatttttatatctcgcaaattgccactaactgaattaatcaaatatcaaaaatatggccccgtcgtatgctgtgaaaatccacaggacaatcccattgcggctgcctatacgctccgtgaaagtacctatcaacaggcgttcgaatgggttaaacaaggtggctatagcaaaattgctattattttaagtcgtccgtacggaaacagtgccacgagtaaaattatttttcactcttacaaaaaagtttttggaactttcccagactccaatttagtctatacggactgctacaattacaatgatggctaccaatccgctcatttaattgcaagaaatacgccagatttcatttttggtaatagcgacgatattattgctggcatttatcaatactacctagataataatttagaattgccggccttaatgggacaggaaaatcaaatatctggaagtctattaaaaatccccacgattgatcaccatctaaaaatgattggtcaagccgcttgcgaacttgctattacgggcgctatcaaatcggtttccatcgagtcagaatttatcatcagataatgtcatcctaatatcacatgctgtagtaaaattagacgatgaagtcatcatctcattttttgttataatgacttttataaattttattcataggagattaggtagtaaccttgcaaacattttacacaattgcactacttttaacaggtgtaatcttatctaatattattaaacaacttgtgcctcgaattcccgaagcatttattttaattatcgttggagtaatcctatcatttaccccagcatttcataattttgaattaagaccagaattttttatgttagtggttattgcacctatcatgtttatagatggtcaaaaacaatccttcaatcgaattcgccaacgttttcgcgtggtattttttctgtcggtagttttagctggcgccagcgctttagttgttggaatcttaactaataattttgaaaccaaatggacgctaccagtggccattgccctagcagccatcgttactcccaccgatgcggttgctgttaaatcgatgaccagcggaactgccatgcccgaaaatgttaatgaagctttagaactagaatccttatttaacgatgccactggactggtaatccttgatttagctttatctgttttacaaaatggaactttttcagcaattaccggagtcgaacattttatttttgtcgcgcttggtggcgtaatcattggaattattgccggctttttaattgtttctcttcgcgttaatttaaacatgcgcgctaataatccggaaactatcatcattccgattagtctgttgaccccttttctcgtctatcttttagctgaacatttgggaacttctggcattctagccgtcgttgctactggaatggttcataattgggaatctgaacgcctccgtttaacttcaactcgagttcagcttacctcagcaaccgtctggaatactatctcaagtttcctaaatagcgtcgttttcttattccttggagtgactttaccgatggtttggaaagattttatccagatgggaacgatgacgattgctcaattaattggtattagtttactgatttatctatcaatgctagctatccgttactggtggtctgttcatgaaaatccagacaatcctgaccatttcttaggcccacatgacaaatccgtgcatcagctatggtcaaggatatttgcaattagtggtgtgcatgggaccgtgactttggcgatggccttttcacttcctactagaattggaggtcatcccttcccttatcgtgaagaattaattgtgattgccacgctagtaattttaattagtatgttagtcagtgctatcagtcttccgctgatgcttcctgtcaaaacgacggaatattcactcgctgatatcgatcatgttcgtaataagatggtggattatgctactttacaactacgtgataccatcgacgatcacgcggttcgtgaggctttaacggaacagttgcagtcccaaaaaggggcattgaacggccaaattattgattttgatgaatattaggagttaatgtttgaaaccaaagacttcattgtcacttacattcatggaccttcaatttcagctaaatatagtttagaagttgttaatatttatgaaaaaattctaaataattttgtggctcctaactttaatcctcgggagcactttgctaaccgagtacattatatatttaaaaagaactttaaaaaggtatcagctctttgcaaacacgccctctggcacgtcaaaaatgggcaaattaccaaacatcaacgtaccgttgctcgtcaaaaatggttggctgctcaaccttcagatacgctccaacaacgtctggatgttcgggatgctcttttggaactcaacaatgaagtgatcgactctactgataaatacttagacgatgttttgcgtggtcgcttattacgtaaacaaagtaataaccaatatattaacctcgttcgtagatctatcaatcgatactgctcaatggttcgtcatgattataataaacaggcagtctttgtaagtagcgatttatacattcaagcctttcagcaagaatataactttattcaacgtggagtaagccgtggggttattaccccagaaatggcaactgtgctctatgatgagattaatcaagctcaatcactacaattacaacgtactcaacagcttcaaattattacatcttaagcattttaaaaacacctcttgtgcgttacttattgataagtagcacataggaggtgttttagttcgaattaaattaatttaaacaaattttgaacttcattttaagtttgaatgctagcaggtgctattcaaacccatgattaatacccgtatgtttcatatggctataaaatgtaacttggaaatgataatttatcataaaataatcccctattaacttttttctaggtacatttttataaaaatttaatttcaaattcaacgggataatcttatttttatctgcattcagatttaatttatttttaatgctaaccataagtaattaatatataattatggttgtacaaaatcgggtttagctacttttcagtgggaagttgatgttactaattaagttatcggatgttataaaagagaggtgtaagtaatgaataaattttgccaaagctgtggaagaccacttactactacaaatgctggcactaaagccaacggtgactcatcaaattactattgcatttcatgttatcaagatggagctttcactgaccctacccttactattgatgacatcaaggcgaaagggattaaagaaatcaaacaatcaaaaatgaatatattcaaaaaaatatttttgttaatttgttatccatctcgacttcaacgactagatcgttggcgggaatcctaaattaattcagtcattttaaaggttgaccaaaatttgtaagagtattttgcctactttaaatgtgaataaaaatgatatcataagtaaagttaaggtcttatttcaaattacagttccctcacttaggtaagttttgataacagttcgattctgttagagggattcagagaattaatctctaaaaaaaactaggagttggttgatttgcttaaagaatttaaagaatttgtttcacgtggaaacgtccttgatttagctgtcggtgttattattggtggagcttttacttccatcgttaaatcattagttaattatttaattaatcctttaattggtttatttatcggcggaattgatttttcagattgggtacttaaggtagccggagctactttcaagtttggtagttttatcaatgctgtcattaacttcttaatcattgcatttgttgtctttattttggttaaattagtcaacaagtttctccctaagaaagaagaacaagaagacgatgaagctgaagcaattgaaaatagtgaaatttaccttaaagaaattcgcgatgcattagtaaataatcctgaattactttccaacttaaaaaacaaagaagattcaactaaataacctaaaaaacgtttcttgagagttttctcaagaaacgtttttttactaaagttattcagttcttaaagcaattgctgcatcttttttagcagccattctagctggaatatgtccacctaaaatagttaacacagcactaactatgactaagagaatggcatgaactggatttaattgagagactccacttaaaccagtcatcttttccagtacgacattaattgggaaagtacataaccaagctaccacaattccgaaaagtcctgacccaatccctaagatggccgtctctgcatcaaagacacgggtaatatctttcttacgtgctcctagagctttcaatacaccgatttctttagttctttcaattacggacgtgtatgtgataattgcaatcataatcattgatgtaactaacgaaattcctgcaaaagccaccaagacgtacgtaatggcatccatcattccaccagtcagttttgaaatactaccggccatatccgtatatacaatttgatccgcttttttcttgccatcattatatttatcgaggtagtctaagacccggtccttcttcttaaagttacttggataaatttggatagtacttggtgtttcactaccacccaacatcgttagcatctggtttttggtagaagcatccattgtttcaccagtcatgatattctttttgctagctgcttgagcttttacaatatcagaatctttattatcttcgtaaacggatttggttaattgatcactataggcgattccgttggataataagccatcgctattcttagatttcacccgtaagataccgacaacttttagcgttttagtatctttagcattcgccattgatgcatacttatcactaggaacatagttaccagttggcaattttttatagtaagtattattagttaccaatttggccgttttaccgatcaattgattgtaatcaaatttttggttagttttagctgtaattccaaagttctttaaagctgagatgttaatcttattatcgcgatccgcaattaaaacaacatcagtagccttctttggataacttccagataaaacgtggtaattcttctttaagaagctttgatttccatcacgatcaatgggataaactgagccacccacacctgtaacagaagccatcattgaacttgtatctactgtcttagcatcgggatcagcattactaaacttaaccgtttgccatttaccatctttttggctaattaaattcattccggtactgtaagtaaccgcaatatttttagcgtattttttaggcattttcttgacgtaatctaggtacttcgaatctattttatttacgtgttgggctttatccgatttactcaaatcagcttccacatacttatgtttggagaagctactgttttgactgtccgtcattgctgcacttgaatctgaagcaacggccccaattgaaaccggcatagaagccatcgtatcactttgggtttggtcaatttgtttctggaaaccatttgataaggccaaaacaatcgcaatactgataattccaatcgaggaagcaaaaaccgtcaagaatgtccgaccttttttagtcataatattcttaaaagaaagtttcaaagctgtccaataactcatcttagtatgtttaagcttaaagttggtcacttcatcatgcccattataagggttggaatctgtttggattttaccaccggcaaactcaataattcggtcagcatattggcgagccaattctggattatgagtaaccattactaccagacgttctttagatagttctttaatcaattgcatgatttcatctgaagtctctgaatcaagagctccagttggttcatcagcaagcagaatttctggatcattggcaatggctcgggcgatggccactcgttgcatctgaccacccgatagttggttaggtcgcttgttcatatgcttctctaaaccaactcgaattaaagcatctttagcacggcgcttcttttcttctccactcacgcctgataaagtcatccccatctcaacgttatcaataatcgaaagatgaccaataatattgtacgattggaaaataaatcctacagaattattgcggtaagcatcccaatctgaatctttaaagtcgtcggttgattttccttcaataaccaaattaccagaatcatagcgatctaaaccgcctatcatattcagcatagtggtcttaccagaaccagaaggtcctaagattgctacaaattcttgattacggaaagaaacagaaacgtcatcaagggctttggtggttgtttcaccgaccttatagtatttctttagatgttttaactctaacatatacgctacttcctttttcatttggttatgttaattatagacaatagttaacaattgtcaaccattaatcaaagttaaattaatatgctataataacgttatataatatttataggaggtgaactacccaatggataataaaccttaccaatcagaatgggatcagttaccagaaaacgtcaaagtaaccgcgcaattattcggcacacttgctcaaactatttttagctattttaacgatgaaactattaaaatatcgcctttgaattttatgattttaatggatattttaggtaatcctggtacctccatgtctgaattggctaaaagagtcggtatttctaaaccacaattaagtcggagcgttagcaaattagaagatctacacatgatcaaaagggtccacaacacggaaaatcggcgtaacgttaatgtttaccccgacaaagaaggtagtgatttaatggcgcagcaatttcttcgggttgccaatagattggataaaacccttagtgccctttcttcagaagaccgtgctcgcctagttcctttaatgacggaatcacttgagattctatccaaggctggtattgttcaacaataatttgtttacgatttatgaaaaaagagccttacaagtaactacttgtaaggctctctttaacttcaatttaacttaattttttgctcaatttttgttacaaggttgctaacctcaccattactataagtgactaagttcgtaattgtcgtttgatcaattttaggcgagctagtttgcaacacttgtttattaattgcaattaatattttaggatctgacgcaaactttgaaagttcttcaacttcgccagtagcaacatccacgtctacaattcccacctttacgagcgccttttttagtttattcaccaacctcgaatcgagcatcgcttccactatgggtcctgccccatttgacgtctgtaaaataccaaccattcccgtattgataactacaactttttcaaccatgctatcctacctccaattttattagaaaacaaaatcccccaaatcaattgtagttgatttagaggattttgcttcacttattttacttggtagttgttttaagaactaatgattctggtgtaactagtgcattacctttgaacttcatcacccgaactgcatccatgttcgtaacgatgacgatcatcggtgtctgcttacccgcatttttaattgcgtctaagtcaactttagctacaacgtcaccatgtttaaccgtttgtccatcttccaccttaacatcgaatggagcaccatttaattcaacagtgtcgattcccatatgaagaagaatttctaaaccagcatctgtcttgaaaccaattgcatgtttagtagggaatactgatgtaattgttccatcaaccggagcagtaatcgttccatcagtaggattaatagcatatccgtcacctaacatcttttgagcaaacgtatcatcaggaacttcctcaatatccatatattgtccattagcaacactatagaactcttccgtaacatcccgtttaataccatcagcaaccgtttcttctgttgaagctgtttcatcagcagtcttcactgaagaaattggggccttagcattgtttaattttgcaagttcatctgaaacaaattgaacttcagtaccaataataatttgtaaattattcttatcaatcttgttcaatcctgcagcaccactgcgtttaattgcattttcattaatattatctgtatcatccaatttaagacgaagacgtgtcgtacagttgtccacgacttgtaagttgtctgaaccgcctagagcagcatagatctttttagcttgaacagtatacttatcatctgaatcattagttgcaactccttcaacaccatcgtcctcagctaattcttcgcgacctggggtcatcaaatggaatttcttaatcgcaaaatcgaaaccaaaatagtaaattacagccattacgaggccttgaacaattaaccataatggttggttagcgatcgggttcttcaaactaagcacataatcaactaaaccggcactgaatgcaaaaccagctgtccaatgcataaatgccgcaaatgcgagtgaaaggccagtaaagattgcgtgcaatacgtatagaggccatgcaacaaacataaatgagaattcaagtggttctgtaacaccggtgaagaatgaagcaaatgcagcagctaacatcaatgatgccgtagttgctttgttttcaggacgagcatttttgtaaatagcgtaagctccggctggaagtccaaacatcatgattgggaagaatccagcttggtacatacctgtaacaccctttgtaccttgagaagccaagaatttaccaatatcattaatcccagccacgtcaaaccagaatacggaattcaaagcttgatgtaaaccagttgggataaggagacggttgaagaaaccgtacaatccagcaccaacccagcctaagttcaagataaacttagcaaacgcaacgagagcgccgtaaactggtggccaaacaaatagtaacactacactgacaagtagcataacaagggcagccataattggtactaaacgcttaccactaaagaaggaaagagccatcggtaattttgtttcgtggaatcgattgtataatgctgcagcaatcaaaccagcgataataccgataaatacatttccaatttgagcaaacgaagcatcaacggctgtaggtttgatgttcattaatgtagcaaccgattcaggctttaatacattgaccggtagctcaaaggcaactaacccagcgagggcagcagccccagattgatcgacagacatcccgagggctaaaccaacggcaaataatagcggtagttgacctaaaacagcattaccaccggcttgtaagaaatgagcaactacgtcattactgtaagaagcccaccagttaccaataccaaccaacaaagcggcggcaggcaaaacggctacgggaagttgtaaagaacgacccatgcgttgcaaatatgctttcatgaataatacctccaaatagaatattaaataaatgcgataatccaattctatgttagtggaaacgctatttcaagcgtaaattattggtataatccactttataagccttattttataaaaaaacaaaatcggtatattaacagatgaaattgcaaataactgggaaattaaaaggggagacgaccggatgttatcaacatgtttagcggccgtgttgacttatcatccgcacaatttatcagtcacattaggagaacttttaaaatcagatccgacgactcaaaatttagcgacgttagagggtttcgatattactaagattaatcaaatcctagttcaacacaatgcacgccccttatcagttaattaagtgccttaagttgtgtatagtttcggaagttgtaaaataaaaggcaatagtattaggaggattttacatggcaaaaaaacaactaacacgggtagaggttccggaagcgttaacttggaacgtcaccgatatttttacaactgaagcagattttaaaaaggccattcaacaagttgaaaaacaaattgttgaaattcaagccaattctgaacgaatgaccgagagtgctacacagttattagcattaactgaattactttatgagagtgaagaactccttatgaaagtttatggatatgcggctcgggttaatgatggcgatactgctgacccacatgggaacgatttgatgaatcaagcattattaattgttaataagtgggaagcagccgtatcattttatgatcctaaaataacgcaactatcagcaacacaattggatcaatttttagatgagaagccagaattaaaacaatatgaatttaatttacgtcgaattcaagagcaggctgcccatacccttactcctgctgaagaaaaattgttggctcaacttcaaccggcgattgatgatgcttcagacatttcttcgaaattagatgacgctgatttagattttggaatgattaaagatgaaaatggcgaagaagttcaattaactaatgctacagccagtgaatttgctacttcagcagatcaggatatgcgaatgcgtgctagtaaacaagttgctaaggcgtaccgttcaatgcggaatacctttggtgctacccttaaaagccacgttcatgcccaaaatattttagccacaattaggcattttgatagtgcacgtcagatgaatttggctgatcaaaaaatttcagaagccgtttacgatacgttgattaatacgacacatgaacatctggatttgatgcatgattattatgctttccgaaaagcatacttaggattagatcatatgtatcaatttgatcgacatgttcctttggttgcagatgctaagttaagtttggcatttgaggaaggcaaaaaggttacgatggcagccttggctcctttaggcaaagattatcaaaattatttgcaagaggaatttgaacaacgttggattgatgcagctgaaaataaagggaaacgtagtgggggctatgaggacgacgtttatggagtgcatccatatatcttactaaattggaatgatatttatgatagtacttcaacgttagcccatgaatcgggccacgcacttcagagtgtttacacggataaggcccaacctttctggtattcacaatatccaatctttattgctgaaattgcttcaactttaaacgaaagcttattaaaccattatatgttagaaaaatatgctgatgatcctcaaattaaagcatttattttaacacaagatgtggacaactttattggtacggtttatcgccaaactctttttgcggaatttgagcattttatttatacagaagatgccaaaggaacgacccttacccccgatttgatggctgataaatttaacggattgtttaaagaatataatggagatgctgtaacagatttaccttggaaagacgatacttgggcgcaaattcctcatttctattacgattattatgtttaccaatacgctacatctaaagccatcgcaaccgctttagccgatgatattatttctggtaaacctggtgcattggaaaactataagaaattcttatcagctggagcaagtaattatccggtcgaaatagttaagcaggctggggtagatgtaactaaacgtgactatcttgatcaagcatttaaactatttggtgaagaagtcgaagaattaaagcgaattttataatatttaaactaagatattggaattaaagtcataaaaaaactccccgagttaaaatggggagcatctagttttatacattcaatttaggcatgatacttgtaatttatcctacttgtaccatgttttttatttaataaaattgatcttttaaactatttgaagaacttaactatatttaatttagttgggttctttttttatggactgaagaaatttttaactagtattgggaataaattttattttagggtcatatttttaatatgtgtcttcgcgataactctcttgtaataatccatcgaagaaatgttgaatcgagatttgaccgcgttgggctccgacttctcgaattctttgcatttcattataaacgttctggaaatcaaataaactgttggcatattctagcagaacttcattttcgggatattcaatacacataccggctaaattgcaaataccaacacgtaaggcacgccgaattctttgaaaggcactttttttctcatgttcatttaaagaaagactttcttgaaaatcaatctttgagaaaggaatattttgatcgaccataactttagcaatccgtaagatatcatcacaaccattttcagaagcaatccctaaaaagcggaggattgaatggattcgatcggttcgaagacgatgcttagattgtggtcgattgaatggtgtggcaattccagacgttaatttgttaatttcagccattttatcaactacttggcagtaagaacccactagcttcgtaatatttttaaactccagatgattaaaaggataatctaaataagcgtcaattcctacacgataagcttcgtctttataggcctcattatgaggtcccaccacaataaagtgaggtttgatgtggacttgagcgagacgtttgatcaaatttagcccttctggaaaaatttctaagcaattgatgatcattacgtcgactcttagttgtaataaatcgtcataggcactatcaacatcgaaattaactccaaccagtgagttactaaaatccgattcaataatattttgaacgatggaaacacttgattcatcgtctgatagtaaataaaagttcatagtcggatctccttttgaagttttttgaagttatatgatactttatgaattatacaataataagatataaaaatgaaaaaaatgacaatttttttgttatataaaatatttattcaaaaaataagtgattttattcaaaaaatattcatttatgaaaacgatttaaataaaaataatattaatttttaagaaaatcaattgatcactgaagctttgtgaaagcgcttgctagaattaaacacgtaatcaaatatagaggaggacgttaaaatgtcatttaacttacgtaaccgcagttttttaaccttatcagattttagtactcgtgaaatggaatacatgcttaatttagctgaggatttaaagaaagctaaatatgctggctatgaaggtaatcgtttggctggcaagaatatcgctttgatttttgaaaaagattcaactcgaacacgttgtgcttttgaagttggtgctaaagatgaaggtgctcacgtaacttatcttggtccttcaggctcacacattggctacaaagaatcagttaaagatacagctcgtgtcttgggtggtatgtttgatgggattgaatatcgtggattctcacaacgctcagcagaaacgttagctgaatattcaggtgttcctgtatggaatggtttaactgatgaagatcacccaactcaagttttagctgatttcctaacggctaaggaagttttgaagaaagaatataaagatattaaatttgcttttgttggagacggtcaagacaacgtatctaatgctttgatgctaggtgctgcggtaatgggaatggaatatcacgttgtaacccctaaagaacttgaaccaaccaaggacgttttagacaaagctaacgcaattgctgctaaaacaggcggtaaaatcgttgttgaaaatgacgttaaagctggtgttaagaatatggatgttatctataccgatgtatgggtatcaatgggtgaaccagatgaaatgtggcaaaagcgtattaaattattgaagccatatcaagtaactaaagaagtgatggaagctaccgaaaatccaaatgcaatctttgaacactgtctgcctgcattccacaatacagacacatcaattggtaaaaagattgaagaaaaatatggtctatctgaaatggaagttactgatgaagtctttgaaagtagtcaatcagttgtattccaagaagctgaaaatcggatgcacacaattaaagctgtcatggttgcaactttaggtgactaaggagggcgagtttatgtcaaaaatggtggttgccttaggtggcaatgctttaggaaagagccctgaggaacagttacagttagtaaaaaatacggctgcatcattgattggtttggtacgtgatgatcatcaagtagtaattagtcatgggaatggtcctcaagttgggcaaatcaatcttgggatgaactacgccgccgaacatggtaaaacagcagcttttccgttcccagagtgtggggcaatgagtcagggttatatagggtatcatctacaacaaagtttacaaaatgaacttgcaaaacgaaacatggataaaaatgttgtgacaactataactcaaattgaagttgaccaagatgatactgcttttcaaaaaccgactaaaccagtgggtgatttctacagcaaagaacaagccgcacaaattgaagctgaaaaaggatatacatttgtcgaagatgcaggacgtggatatcgccaagttgtagcttctccattaccaaaatcaattattgaaatcaatagtattaaaacgcttgtcgaacacggtgatttggtaatcgctggcggtggtggtggcgttccagtcattaaaactgaaactggcttaaagggagtaccagctgtaattgataaagatcgttcgagcgccttgctagctgataatatcgatgccgataaattgattattctcacagctgttgactatgtttacgttaattataataagccagaacaaaaagtgctcaagcaactaagcgttgaagaagcccaaaagtacatggatgacggacaatttgcagctggaagtatgctaccaaaagtacaggcatgcttatcttttgttaagggacaccctgaacgtgaagcaattattacctcattaaatggtttggatgacgctttgaaaggtaatttaggtacagtaattcacggctaaataatttacttaagtaccaggtagaaaaaaataagaataggagtgtgattatagtggcgaacgcaattcatgtaacttcagaaatcggaaaacttaagacagttatgttacatcgtccgggtaaagaaattgaaaatattaccccggattcgatggaaagattattgtttgatgatattccatatctaccaatcgctcaaaaagaacatgacttttttgctaagaccttgacagatcaagggattgaagtgatttattttgaaaaattggcagctgatgctttaagtgacgatggagtaagaaaagaattcttaaatagaatgattgctgaatctggctatgcagttggagtaatccatgacgctttaatggaatatctttacgcaatggatcctcagatgatgattaatcaaattattgaaggggtacgagcaagcgatgttaatattgttactcctgacttacaatccgtttctgagaatacagattggcctttcttaatggatccaatgcctaacgcatactttactcgcgatccccaagcatcaattggagatgggttatctatcaacaagatgacttttgaagcacgcatgcgtgagtccttaattaccgaatatatcatgaactacaatcctcgctttgctggaaaagtcaaggtatggcgagaccgtaatcatcgtacccatattgaaggtggggatgaattagttttaaatgatcatgtattagcaattggtatctctcaacgtacgacagcgaatgcaattgaagatatcgctcgtaatttattcaaagattctaattatgacacgattattgcaatttcaatacctcataatcatgcaatgatgcatttggatacagtatttacgatgattaattatgaacaatttacagtacatccagcaattttaactggtgatggaaaagttgataactgggtacttcatcctggtaaagatggtgagattacaatggaacatcatacagacattaaggaagtcttgaagaaggctcttaataagtctgaaattgacttaattccaactggtaatggtgatccaattgtggctccaagagaacaatggaatgatggttcaaatacgttatcaatcgctcctggcgttgttgtaacttacgacagaaattacgtatcgaacgacttactacgtcaacacggtattctggtccatgaggttcgttcaagtgaattatctcgcggacgtggcggtccacggtgcatgtcctgcccaattgttcgtgaagacatctaaaaataattttatggcagaagtgaactgtggtactagaaaatagtagacagtttacttttgccatttttattaaatttaagaatggagtgaagaacatggaaaataaaaacggaattgggcgactaggcttaaccgccttaattgttagctcttgtattggaaccggaatctttggaattaccaatgcggttgccgctgctgccgcaccaggaccagcattattgtcttggttgtttgttggaattggttttttgttcttagttttatcattaaataatttatctgaaaaacgccccgatttagaagcaggaatttttagttatgcgggagctggatttggtccattaggtgaattcatttctggatgggcttactggctttcagcttggcttggaaatattgcttttgcaaccatgctgatgagcgcgattggaacttttttaccggccttcaagggtggccaaaacttaccatcaataattgtagcaattattttctgttgggctttaactctactcgtcaatcgtggggtagaaagtgcttcgtttgttaacaccattggaactttctttaagataattccactagttttgtttattatcattgtaattattttctttaaaggtcacatgtttacaactgatttttggggaaacgttaccaataacttttccaaaggaactacaaccggatcaatttttgaacaattgaagggaacattatcaactttaatttgggtattcattggtgttgaaggtgcttcagttatgggccatcgtgctaaaactagaagtcaagctcagcaagccacgattatcggctttgttttacttctgataatttatgtcatgatttcaattatcccttacggaacactaacacgtgcccagttggcgggtgctgaacaaccagctttaggaaatgatttacaattaattgttggtagttggggcgcaatgattattaatataggtttgatcatttctacggttatctcatggttatcgtggacgatgttaccagctgaaactacaatgttaattgctaaagataaggttatgccaaaagtttggggtaaattaaatgaaagaaaagctccaacaacgtcactaatgattacagcggttctacaaactattttcttattctcattgctattcacctccgaagcttataattttgcttattcattagcttcagcagctattctattctcctacctatttgtgggattgtatcaaatgaaatacagctacaaggaaaagcaatggggacagtggacaattggcttaattgcagctttattccagtttgcctgcatggtgctatctggttggcaacaaattttgttagtctctatcagtttcatcccaggattcattatctattatcaagcaacgaaagaaaataaacgtactttaactggtaaagagaaagttatgatggggatgattttgattctcagtttgattgccatttatttggtagttaatggaacaattgttgtgagctaattaagcaggttaaaagtataatttgtctaagaaattaagacgaaatatgattttttgattgtatagggtattggacactaattaagttacgaagaatttagacaaatattctgaagcatcacgtatatcaaataactaattaaaatttttgggagtaatttgaatgacagagaaaaatgggaaaataggcttattaactttgagtgccctagtaattagttcatctattggtagtggtgtttttggaattatgtcagatcttgcgagggctgcagcgccgggaccggttttaattacgtggtttattgttggtttgggtgttatgatgctggctttatcgttaaacaatttattattaaaagaaccagagctagagggaatattttcctatcccaagaaaggatttggccctttcatgggttttattagtggttggggatattggttgtcggcatggttgggtagtgtggcatttgcaaccttcctgatgagcacaataggttatttttttccaattcttaggtcagaacgaaatttaccattaattctaattgcaagtatcttttcatggggactgacatatctagttaaccgcggcatcgaaggtgctgccataattaatacaattgtaaccgtatgcaaattgattcctttatttgtatttattgtatttggaattattctttttaaaggcggaatgtttacgcatgccttttggaataatatgaataataattttgttggtggagatgttataggtcaagttaagaactgcatgatggtaatgatgtgggtttttgttggaattgaaggtgcctcaatactatcggcacgagctgaaaagaaatcggatgcgggaaaagcaaccattttgggtttgattagcttattagttatctacattttggcatcagttttaccatatggatatttaacccaagaacagttggcagcgattaaacaaccagccatgctatatatatttgaaaagatggttggtacttggggtggatacttcattggaattggattaattgtatcaatcctaggtgcgtggctttcctggacgatgttaccagccgagacaatgttattgatggcaaagcaaaaactattaccagaatattttgggaaaattaatgataaaaaagctcccacttttgccttaattttaacggctggattaatacagattttcttatttaccctattttttacaactaaagcatacaattttgcttattctctttgtaccgcagcggtgattgtgtgttatatcctggttgcagcttaccagattaaatattcgtggacacatatccatgaaaaaggaaatcagcaacaattggtaattggtgtcctagccttgttgtttgaagtaataggcattttaatggcagggttaagttatttattgctatgttttattgcatacatccctggaatttatttttatggtcaggctcgtaaaaataatggacacgaatatttcctctctaagggagaactgatagtaacagtatttataacaattggtgctctaattggaatggggttagtgataatgggaaaaattatagtttgaattgtagaaaaataaaggtgcaacgattaaagaaattcaagatatggaagtaatagccagcgagctaaaacattaaccacttcgagtgtgcaatcaaagcttatacaagctttgataacaaagtgtgccggagatttgtatatttctcacatccattaaacaacaaaaaatttgtatagcctcaaagagatcatatttaaaaattatttttaattaagtaaataatttaaagtagtagattgaaaaaatataagttcaaaaattttaatatatggcctgaagcattttaagtatggaaagtttaacttccaaaatggtgtctgacgcttaaggccatattttatatccacataaaatatgaggtgataaaaatgaccagtaaagccaaaagacgttttaaattaaaaatgcccggtgcctttgtaattttatttattttaacaattgtagcagttattgcgacatggacagtcccttctggtagttatgctaagttagcctataatcagactacttcaagtttgcaggttaaagatcctgggggcgaggttcataaggtacctgccactcaaaaggaattaaataagttgggagttaagattgatataaaaaaatttacttcaggagggattacgcaagaaatttcgattcccaatacatatcagcgtttgaagcaacatccagctagtattactaaagtgactacgagtatggtacgtggaacaattgaagctgtagacattatggtattcatctttgtcttaggcgggttgattggggttgttagggctagtggagcatttgaatcaggactggttgctttaaccaagaaaactaaaggtcatgaatttttattaatttttttggtagcaattttgatgatattaggtggaacgttgtgtgggattgaagaagaggccgtagctttttatccaattttagtgccggtattcattgcaatgggatatgattccatagtatgcgtaggagcaatctttttagcaagttcgattggaacagcattttcaacgattaatccgttttcagtcgtaattgcatcgaatgcggcgggaattaattttacagaaggaattggatggcgtgtgtttggatgcatagtggcagctatttttgttgtaggttatttatactggtatagtcgaaaagttaaggacaatcctcagttttcatattcgtatgaagatcgtaacacgttcaatagtaagtggtcggttgaaagtactgatgacagtgaggcaagttttactaaacggaagaaaattattttattgttattcgttgccggatttccactgatggtgtggggggtaatgacacagggatggtggtttccaaccatggcgtcttcgttcttagcatttgcgattattatcatgtttctgactggtacaggagcaaatggtattggtgaaaaaggcgttgtagatgcgtttgttaatggagcatctagtttggtaggagtttctttgattattgggctagcacgtggaattaaccttattttaaatgaggggatgatctctgatacaattctagatttctcttcagctctagtagctaacatgagtggtccaatatttattattgtgatgttattgatttattttgtattgggattcattgttccgtcttcttctggattagcagtcttatcgatgccgattttggcccctttggctgatacagttgaaataccaagatttgtggtagtaacagcataccaatttggtcaatatgcaatgttattcttagcaccaactggattagtaatggcgacgttgcaaatgttagacatgcagtattcacactggttaagatttgtatggcctgtggtggtcttcttgttagtatttggcggaggaatcctagtagcacaagttttaatatattaaaaaataaaaacaccggaatttaaattccggtgttttgctgctttaatattaagcataaagggtaaaaagggtacatgaattataaagtgttaattgttaagggatcaaattgaagcaaattgctcctagaatggcaccaacaactggtcccaaaataggaacccaactataggcccaatctgagccgcctttgttagcgattggaagcatcgcatgtgcgagacgaggacctaaatcccgcgcaggatttatggcgtaaccggtagttccgccaagtgaaagtccgattgctgtaatgagaaccccaacagcgattggattaagaccctgagtgaattgtccccgagtaaaggctaataaaccgaaaataagtactgctgtaccaacaacttcactaataaagttcatgctgtaattgcgaatagcaggttctgtagcaaaggtaccaagaatagcatctttgtctttggtttctttccaatgtgggtaataatgaatccaaacgacaatcccaccaactaaaccacctaaaatttgagcaatgctataaggaataacgcttgaccaaggaaatttaccggcaattgccattccgactgaaactgcaggatttaaatgggcagggctgaggaaagaggatgcataaacccctaatgtaacagctaatccccagcctaaagtaatggcgatccaaccagaaccttcagcttttgactttctaaggctaactccagccacaacaccgtcaccaagtaaaactagtacaaatgttccaataaactcccccagtagttgaagcgataaactattatccatgaaaaggttcctcctattttaggtaagtaaggctagcttcatcgattgtttcttggagtttcttcgcttgagcttcacgctcttcgtcagaccattcgaagtaacgagccatttcattaataacaccctttttaacatcatcaattgtatcgtggtggaaaagaaggtgattggtacggcggagcaagtagtcaacaggtgtcagcgtcatttcttcattcattgaataatgtagactaattgtctcagcaagtgttagcccgggtgctgcttcaattttaccaatctggctaaatacacgagcagcatttgatccaaataggttagctatttgttcagcctcagcttttgatagaccactttcaattccttgtttagcgaagaatgaaagggtagcgtcgacgttattaggatcaatatcaccaccagaaacttggagatgcttagaatcaatttcgttgaatgtttcgttgaagtcttctttgagaactttggtgattagagcaatggctccagcagccattttacgataatcggtaatttttccacctgcaagggtgattagcccatcgtttgcaacgtcgagggcgctaccacgagatacagcagaaggatttttttctgagagggtgctttctagattattaaggacatcttcaacgtcaactcgatcagcttctttattttcatacttatttacaatatcaatgacttcatcaaagctatccgaagtaatttttccggaattaccaccattgtagtctgagctaccattggaagaaattagaggacgtaaacctgcccaactagcttcaatatcatcaatcgtaatcttagcttctggataatgtttattaatgatacttaacaagtaatcgacgtcctcttgctcaactcgtggatgcaagaagtcgcctttgtaatctgtatcggtggttccaaaataggtctttccttcgcgaggaattgcgaaaatcatacgaccatcttgtttgccagagtcaaagtaagttggctgagggacgtttagacgtgagcgatcaacaaccaagtgcacccctttagtagggcgcatctgtggaacaacttcttctttatcatccatttcacgaataaagtccgaccaaggacccgttgtgttgattaccaatttagcgtgaatatcaaattcttcaccagttaagagatctttaacgttaacaccatttacacgaccattttcatcatgcagaatgtgttgagctttgatatgactgaccattaagccaccattttcatgagcttttttgatgttttcaatcactaaacgagcatcattattacgaaaatcaaggtaaacaccaccacccaaaagaccttccggattaagttgaggctcacgttgaagaacctcgtcttttgaaatagtgtagttggtgtatttaggatctgtaacaccagcaagttgatcgtacaaattcattgcaattttaactgaaaacatatcaaaggttgatccaggttcgtcataaattggaagaagcattggatcagggcgaggaatatgaggggcaattccttgaacaaccgcgcgttctttaacggtatcagaaactacctcgacatcgaaatttttaagataacgaattccaccatgaactaacttggttgaacgagaagatgttccttcagcgaaatcttgcatttcaattagggcgttgttcatacccatggcgcttgcttgaatagcaacacctgcgccggtgattccaccaccgatggtaagtaagtcgagcgtttcatttttcaatctttcgatatcttgttttctactaattaatgagaatgacatgaaataagcctcctaagttattttgattgtcgtggtcgatgtttaaattgacgagttgctgcaaccgcttcttgccaacctgtgtataagtcttcacgctcatcagttgacatctttggtttgaataccttccctggcttatattctttctttaaatcttcaaggtctttccagaatccaactgctaatcccgcaagaaatgcggcgcctagagcggtggtttcgagatcactagcacgatcaatttcaattcctaaaatatcagattggaattgcatcaagtaatcattattagaagcgccaccatcgacacgaatggaaggaatatcaattcccgaatcctttttcatagtgtcaataacgtcacgagattggtatgcaagggattgaagggtagctttaatgaaatcttcacgggtagttccacgagtgattccaaaaactgaacctcgagcattaggatcccagtacggagcacccagtccagtaaaagctggtacaacatagacttcattatcattttgagaagaaacagcggctgcctctgattcagaagcctttataaacagtttcattccatcacgaagccattgaattgccgaaccagccacaaaaatactaccttctagtgcgtaatagactttgccattaataccgtaaccaatggtggttaataaattattatcagataattgcggtttttcacctgtgttcattacggtaaatgcaccagtcccgtaggtatttttgaccattccgggttcgaaagctaattggccaaataaggccgcttgctgatcgccagccattccagagatgggaacttcgctaccataaaagtggtaatctttggttttaccgtaaatggtagagttaggtttaacttccggaagcattgaagcagggatattaagtaaagcgagaatttctttatcccattctaatttgtgaatgttatacaacatggtgcggctagcgttggaatagtcagtgacgtgcgcatcaccatccgttaatttccacattagccatgtatcaatggttccaaacaacagctcgccgcgttcggcgcgtgcttgtgcgccatcaacgtggtcaagaatccagcgaattttggttgccgagaagtaagcgtctgtaactagtcccgttttttggtgaatcatgtcgccatacccatcttttacgagttgttcagcaatttctgctgtctgtcgagattgccacactacagcgttataaatgggaagtccggtctttttatcccaaatcacggtagtttctcgttgattggtaataccaattccactaatttggttgggcttaattcctgactcgataaatgcattagcaatggtcgacaatacggcattccatatttcgttggcattatgttctacccatccaggtttcggaaagtactgtggaaattctctttgagcatctgccattttatttccagcatgatcaaagatgattgtacgagtactagtcgtcccttcgtcgatggcaagaatatatttgtctgccatgtccgtacctccgtttttttaatttgttaagattcaagaaagcgctttctaaagatctcgttgttaattataaatcgtttttaataattaaaaaacaaaaacgcttgtgaaatattgtctaatatttatcatttttttaaaaaatgttttattatttgaaagttaatatcattttataatccgaagtgactgttataggggattttgattcggataattgacaaaaaagtgctattaaataaaggaactgattgtaaacttactataaaaagaagcatcaagcagcacgctaggtgctgtttgatgcttctttagtggtttagtttatttttgcaaaatgggcagcgatttttttacgatttccccgatgagtagtaacaatcaaggtatcaccaggtttaattactgaatcaccacttggaataattgaattagagccgcgacgaatgctaattaataaactttctttgggccaagaaatattgcgaactgctaaaccatccagcttagaaccttcgacaattggaatttctactcggtcttgaggcccactaggagtggcagtaatagttggaactaattgatgaagtaaagattcataaattggttcaccgccgagtaaatctaatacaatgtaggcggtaagcgccacaacggctagtggcattaaatgttgtagcgaaccaaccatttcagtaatcagtagaattgcagtaaatggtgctttaccaatggcggcaaagtagccagccatggcataaatcacaaagttgggtaagtaatggatatcaattagattaagattagccatgatactaacgtacaaagccccaaatacagcacccagggttaggattggaagaaaaattcctccgggtaatccagacccataagataccatggaaaaaatgaatcgaataattaatagggtgaaaagcgtcataaaaatcggatttttgttagcaattgcagtaatgatggaatttccaccacctaaatatgatggccataaaattccgatgggaataatcgttataaaaggcactaaactatggagccaacgtggtaaaaagctaattttttgataccatttttttagatttaatgtacaaagctgatatagtcgtccaaaaaggcccaataaaatccccaaggcaattaggtgccagtaaagcccaagaggcaaagaatgaggatatctaatcgctaaaactggagttaaaccaaaaaagttaagagaaacaaagtttgacacaacggcgctggtaagggcactaatccaaaccaacggagaaaagttatggtagatttcttccaaaacgaatagagtactagcaataggagcattaaaagcagctgaaaggccagctgcggctccaccagcgattaaaacgcgacgttgagaaccactatagtggagggtttcactccaaccttgacctactaccgctcctaactgaatagaagggccttcacgccctagcatcaagccagatccgattgctaaaatcccaccagtaaactttttccaaagtactggccaccatttttcttcatattcaccagataattgtccttcaatttgaggaattcctgagccagatatttggggagaagttttaactaacaatcctaccaacactgctaaaataatattaattactacaatcagggccaaccaatgccaactggaactggctagtcgataaattgattgtgaaatttctagaagatgttcgattgctagtctaaatgtgctgacaattaaaccaatcaaagttccaataaaaatagagtttagtaaagtagataatcgagtatcttcaattttcaaatgcatttgtttcacaccttatttaaacgtaattatttctatagtatcatacgaagaagctgaaaatgttcaaatttatttgataaataaaaacggtataatagaaggaaatagatttaggatggtgttttaataatgaaaaaagtagttagctttgcaggatttgatactttatttgatacagaagttttttacagagcaattggtcgattaggtgaacgttataatattgacgataatttagttcgtaacacttacgttgaaaaagaattagctttgatgaaagctgatgagtttgtaaaatactccaagttaatggaagaagccctcaatcaaacggcagatgagttaggatttaaagttgaccctagtgactttagtgatgttttgattgctcataccgtgatgaagcctttccctgatgcaccgactgcgctttatcaaattaaagctaaaggctatgaaacagtattgatgacgaaccattctagagatttaattcaaagtaatgtgattaatctagatcatgaatttgatatgattattacggcagaagatgttcagacatataagcctaatcaaaaattctttgactatgttaatgatcaactcggcaatgatgtagagaaacatgttcatgttgctgtagatgaagttaaagatttgaaacctgcccaagatgctggttggaacgtgattaagattgatcgtaagtctgaggatgcatcgattgcatcattaatggacacagtagataaactataatttgtcgcatattgttagtttgtaaaatcgatttctgttattctaaccatgtttagatgataggaggaaagtacaatgttaaatcaaatcaaaattggtaaaagtgcagttgaaactacaactttaggattagggaccaataaagttggcggacataacttgtttgaagggttggaagatcaagatggttacgaagtagttagaaccgctttggatagcaacattaagttgttagatacagcttatgcatacgggtatggtcgttcagaagaaatcattggtgatgtaattaaagattatgaccgtagtaatataacgattgcaactaaggcagctcaggacgtaaaccttgattataagcctaacaataatccggaatttttaactcaacaaattgatcatgccttgaaacgattaaaaaccgattatattgatattttttatatccactttccagatgaaaccactaacaaagcagaagcaattgaagccttagttaaggcacgggatgcaggtaagatcaaagccattggagtttctaactttagtttagagcaaattaaagaggccaatgctgatgatgttattgacgttgtcgaggatcattacagtcttgtgcatcgtgatgctgaaaaagaattaattccatatttaaatgagcataatattacttttgttccatactttccattagcttctggaattttgactggtaaatatgctaagacagatagcggaaagttcaaccaatattcccaagcggaatttgatcaaatcatcgatgccgttgaaaaggtacgtggaattgctgaaagtaaagatgcaacggtagctcaagtagtgttggcatggtatctaaagaaccccaacctcggcattgtaattccaggagctcgtaaagcagaacaggtaaaaagtaacgttaaagctaccgcaatcgaactaagcgatcaagaataccgtcaaatcgatgcgtggtttaaattttaacaactgaatcaaaagtcattaacaaagatgctagagcaccaaaaagttagaccaaaaatctagctattggaagtcactacagagataggttaatggctttttttatttgtagtttataagcgttttaattgtaagcggttcacaaaaagagttagactgtagacgtaatattaagaaatagggggataatacagatggataaagtgaaagttatcattgttggggcatcacatggagggcacgaatcggcgattgagctattagataaatacgataatgtcgatgttacgatctatgaaatgggagatttcgtatcgtttatgtcgtgtgggatgcaactttatttagaagaccaagttacagacgttaatgacgtaagaaatttccggccagaggatatcacttctaaaggtggaaagatttataacaatcatcaagttacagcaattgatgttgatcaaaaacaggtgacagttaaagacctgaaagcaggttcagaagaacaagtagcttatgataaattaattcttagttcaggagtaacacctaagaatctaccggtaccaggcacagatcttaaaaatgtttatttaatgcgtggttatgactgggcaactaagattaaagctgccttgactgatgatagcattaaaaacgtagccgtaattggttcaggatatattggaattgaagcagctgaagtatttgctaagaaaggtaaacacgtcaccttattcgatttcatcgaccgtcccctcggaaattacctaaaccatgaaatgacggaaattattgataaaacattaactgacaatggtattcaagtagaaatgagccaaagtatcactgcatttaaaggcgatgataaagttgccagtgtagaaactaaaaagggaagttatcctgcagatttggtaattcaagctgcgggtgtccaacctaatacagaatggcttaagggcgttgtggacttgactgatcgaggattcatcaatgtagatggatacttgaggaccaatgtgccagacgtattcgccattggagatgcgatcttaccattatcgattccagccggaaaaccatcgccgattgccctagctacaaccgcccgtcgagaagctcaatatgttgtgaaccatatttttgaaaagaaaccaactcaaatttttaagggagttgttggttcatcagccttacatgtgtttgacgaacattttgcttcgaccggtgtaaatgaatttacggcagagcgttctaatgttgaaattgttaactcacattacgtagatcatattcgccccgcgtatgttcccaaggcggaaggaaatgtgcgcgttgatgttgatatcacgtttgacccccatacccacattgttttaggcggcgcggtactttcgaccgctgacatgacggcacaaggaaatgttttagctttggcagtggaacaccgattgacggtagaagacttggctgaagcagatttcttcttccaaccaggctacgaccgacaatggagtttaattaatttagctgcgcaacatgctttaggatatgcacgtttctaaagtagattcaaaaaaagtttgatacgcgatttttaatcaagtatcaaacttttttatttcattagcgaatttccataaattaaatcggcaatcttttgttgattgggacttagaatccggtctttacgttggaccaaattcatatagaagaaaggttggtcttcatcataaaaaggcaatgctttaatatctgggcgggtagtgagtgctgaattggcgataaatccgaccccaacattttgagcaaccatttcttgaatgacctgagcgtcgttactttgatagacgatattaggtcgaaagtttgtaatcttactaaaattttttaaggcctcagaatgaacgaagttactatcaaaagtaagaaatttttcattctttaattcagaaaaccaaatcttttcacgtttaaagaaaggtgattggttaccaacgatagcggtaaaatggtcttttcccaagtgttggtaggctaaatttcggtgatgttcattttgaaccgatcccattaatgacatatccaaggttccatttaaaagcattttttctaactcagctgatcctttttctacgggaacaatcgcttttaatagattttgttcggtaagctgtttagcgatttttggaaaaaagtatttggtcataatggggggtaatcccaaaatgagtttgttggtattaatattgttgatactattttgcgcaatggcgatatgatccaaaatcgcattaacatgttcatctagttgttgaccgctcaaagtgacatttaagtggtgacgtccttggtcgcgagtgaaaagggtggtattaaactcttcttctaatcggcgaactgacatactaattgtcggttggctaacatgaaaaatttcggcaactgaagaaaaatttttattttttacgagttcatgaaaataattcaaatctttaatgttcatattgcacctccgaaatactattataacagtatttttagaattaatataaaaaatatttataactaataacaaatttgactatagtttttacgaggcattaaacttacacagtaaataagaactggaggaagaaaaatgactgaaaaagcaatgagtattcttaataatccatatttaaataaaggaacggcgttcactaaagaagaacgtgaccaattaggattgaatggtttaattccaccatacattcaaacaatcgatgaacaagttgaacaagtttatgcacaattccaaactaaggccaatgaccttgaaaaacgtttgttcttgatgcaaatctttaacgaaaaccgcgtgttattctacaagttatttagtcaacacgttgttgaatttatgccaatcgtttacgatccaaccatcgcagatacgattgaaaactatagtgaattatatgtacaatcacaaaatgcaacattcctatcaatcgacgatccagatatgatggaagaagctttgaaaaattcagctgctggacgcgacattcgtttgattgttgttactgatgcagaaggtatcttaggtattggtgactggggtactaacggtgttgatatctctgttggtaaattgatggtttatacagctgccgctggtatcgacccaagccaagtattgcctgttgttctagatgttggtactaacaaccaagatttattgaagaatccaatgtatttaggtaaccgtcacgaacggattaaaggtgatcgttactacgattttgttgataagtttgttgaaacagctgaaaacttattccctaacatgtacttgcatttcgaagactttggtcgtgataatgcagctaacattttgaataagtacaaagatcgttatgtaatcttcaatgatgatattcaaggaacaggaattatcacattagctggtatccttggagcattaaacatttctaagcaaaagattacagaccaagtttacttaagctttggtgcaggtacagccggagccggtattttaggacgaatctacgaagaaatgattgaaaatggtttatcagaagaagaagctaagaagcacttctacatggtagacaagcaaggactattgttcgatgacgatgaaacattgacaccagaacaaaaaccatttgctcgcaaacgaagtgaatttgataatgctgatgaactaactgatctattatcagttgttaaagcagttcacccaacaattatggtgggtacttctactcaaccaggttcatttacagaagaagttgtacgtgaaatggcagctcatacagaacgtccaattatcttcccactatcaaatcctactaagttagctgaagctaaagctgaagatttacttaagtggactgatggccgcgcattaattgctactggtattccagtgggagatattgaatacaacggtgtaacttaccaaattggtcaagctaataatgctttagtttaccctggtttaggtttaggtgtgattgcttcgactgctaaggtattgaatgacacaatgatttctaaagctgctcattcattaggtggtatcgtggatgttgaccaaccaggagctgctgtattacctcctgtttcaaaattgagcgatttctctaatactgttgctaaggcaattgctcaaagtgctgttgatcaaggacttacaaaagaaaagattgataatgttgatcaagcagttgaagatacacgttggaatcctgaatactaaaatcaggacaatcggagaaagcaaaagagagaattaaaataagagaagcaaaactgtggagaggacgttggtaaattcgagcgtttcagttttgtgaaaagaagagagtgtgagaaaatgactgcgtttattacgtctgttggaagtattgttacgattcttttaatgatgggcctcggttttgggttgcgaggaatgggttggtttgacgaccaatttagtggtagtatttcaaaattaattatgaatgtggctttaccagcttcaattttcatgtcagtaatgaaatatctaacattacctaagttgattggtctttcaagtggattgatttattcatttggaggagtaattattggttacatcattgcttggattacggttaaattattaaaggtacgtccaggccgtcgtggactatttatgaacacggtagttaatgctaataccatctttatcggattacctttgaatattgctttatttggtacaaagagtttagcctacttcttggtttattatgtaacaaatacagtttcaacatgggccttcggggtcttcttgattgctaatgatgatccaactaagaaagctgacgacaagtctactggccgtaagataaactggaagaaacttcttcctcctccattacttggcttcctagtagctatcgtttggctagtacttggcttgcctgttccaggttgggctggtaacacattgagttacgtaggtaacttggttacaccattatcgttaatctatatcggtatcgtattatacgatgcaggtttgaagagtattcattttgatcgtgatacaatctttgctttgattggtcgttttgttctttcaccacttgtaattacagggttgatcttattaggagcacatacaggtcacagcttaccaacgatggaaatgcaaactttaatcgttcaagcagctgcacctggattagctgttatgccaatcttagctaatgaagcacatggtgatgttaagtacgctaccaacttggttacaactagtacgattttattcattgtcgttgtacgaatcgtaatgacattgatccaatttatctaaaaatataatttaaaagtcacatcacaattataaaaaacatcagcagccacttggagtggttgctgatgttttttgtttactaaaaatttaatgagttctattgattaaataatataatttatgaatttaaaatatcattttacatcatgacggatagtctggtattgttaatatcgttgcgtgtataaaaatatattaaaggtttagtggggagaaaatatatggttgctctaaataaaaaaattaagacgcactggtatcttataattatattagtcataggtatattcataacgatccctcagatacaccatcatattacgattattggtgcagatggattatttcattttaaccggatatatgatactgctatgcagataaaaaatcataatttttcctactttattcaattatatgggttctctaactcaggtcgaatggtcacatcagtatatagtccgttaatcacatatatttttggtggaatattgcttatttgcgggagtttttataaatttgaaattgtaacgcgttttttattttttattttatcaggtttatctatgaattatgcccttaaaatgggaaaggtaaaaaatcaattcatgatccaattggtttgtattatgtacgcatttagtccagctgtaattagatgggatgcggcacagaactttaccagtattggtgcgatgcttattcctttggtagtcgggtgcggcatgcggatggttaataataaagatgagcctatcaattgggttcaactaggtactattatggcagtagtggtacaaacacacctagcaactgctattcaatcagtatttttgttaattatctatgctattattgccctaataattaatagagcttctagaaaaaacttacttaaaaatggtatttacgcagttttgctttgtataagcttatcattaaatgtagtagcgggaatgttcgaattatataatggtaactatatagtgcctattgttaagtttgattttgtcgatggcaagggtatttataatattttacaaatattttctggaaaatgggttaacttgttttttattttagccgtttcttcaactttattgttcttccttaaaaagatatctctagctatgaagattacggggtttttatcattaacattatttttgtgttcaacaactattattattgattggcctactatcatgcatgatagtgctgtttttagtagtttactacaatttccagcacgtttagtaggcccagccacagtgttagcattaattacagttgccagcattggtgattttgagtgtacaaatttctttatcaaacaaattaggaatggactaaccctagtgttgttacttttcttagtagtaaatatgcgctctaattttcgctataatcggagtgcaagccacaatgtattagtttcaaaatcgactactataccatatattggacgtgatcctaaaactttaaaacatattacttatttgatgaagcagcctttaaatgaacaagatattaattatattactaagtcgacttcggattatatgcccgctaatcatagcatagataattctgtatactgggattataacaataaaattatccaaccgaccaaaaataaaaattataaaaaggaagtagcgcaacataagattattgtgacatggaagagcaatggaacttatgataatccaccagttgcatattataaaaataatcattttaaattaaacggcttaccagtaatccctagatcttcgggaggtataattaaggttcctaaggttaaaggaaagattggtaaaaatgttatggaagtaacgtatacgcctaaaaaagttagtgtaatgatgctgtggatagctatgttaagctggatttcaatagtattttatgcttttatacgtctattcagacaggtaaaacgttcatttttatttagtaattaaaaaggcgttgtaacaagtattttctatacaaaataggacaaaataggaaaatattccttaatattaagacaaaaaaataagctgttatcaaagattttatttcctttggtagcagcttatttttaacctcgcgatgggatctcaagtgttgctttttcaattgttcgttctttggtttggcgcattaaatcattaagataaaatcctggttttaaaccagtcttttcttttaaggcatagaccgtcagagtatagtcgtgatcagcaggaggtttaggacctaggtaacgggcctcgattgctgggtcatgaaaatcaatatatttagaaacagaactatttttaccttgcacgatacctgtatttaaaatactaatattttcagggatataattagttgcatcaatatcagtagcaatccaatgaatccaagggaaaccagccacaggaacagcatcatagtcgattaaagttaatgctaatgctttagttccaatcggaatatcactaatattgatagggaatgagcgagttggaaaatcatgggatgtatatgctttgggagcatgcttaccaaattgatctggtaagtagccattaattaagtcaacgctaattttcattaaaaacaccgtccttttttatttaattatagcgttttagagcgtttgaaggaatcgtttttaggaaagcaagctgatgtattgcgtactatcagtaataaaatatgcgataatagaataggaatattagtaaattaatttttacactggaggaagtcattttgaagcttatttcatggaatgtaaatggattgcgtgcagcggttaagcatggatttctggatgtttttaaggaactagatgcagatatattttgtatccaggaaacaaagttgcaagaggggcaagttgaattagaattgcctcactactatcaatattggaattatgcggagaaaaaaggatattctggaacggcaatttttactaaaaaaaagcctcttactgtaagatatggacttggaattgaggaacatgatcaagaaggccgtgtaattactttagaatttgaaaaattttacgtaattacttgttatacaccaaattcacagccaaaattaaagagactagaatatcgaatggcttgggacgatgcatttagagcatacatagaccagttaaatcagcataaacccgttattttctgtggagatttaaacgtggcgcaccaagagattgatttaaagaatgataaaactaatcataaaaatgcaggatttacggatgaggaacgcaataaatttacacagttattaaatagtggttttacagatacataccgatacttctacccctcaaaagaaggagtttattcttggtggagctatcgatttaatgcacgtgctaataatgctggatggcggattgactactttgttagttcaaaggcgttggatcaaaaattgactgacgcccagattcatactgaaatttttggttccgatcattgtccagtcgaattagatcttgatatataagtcatgggagagaaaagatgagtttaccaaaaaaattggaagagatgcaggttgaagaagctagtaaattagcgcaaaaccttagagagactttggatcgttggagcaaattatattacaccaaagatgctcctgaagttgaagattacgaatatgacgaaaaatatgcggatttagtggcgttagaagaagcttttccagaaatcatcacccaagattcgatcactcaacgagttggtggtgaaattttagagggctttaccaaagttacccatacagaaccgatgttgtcgatgggggatgttttttcgcgcgatgaattagttgaatttgataatcgtatccaaaaaaatgttgggcatccagttgattataatgttgaattaaaaattgatggattggcaatttcattaatttatcaagatggtgagctgattcagggctctacccgtggagatggaaatattggtgaagatattactaagaacttaaaaactattaagtcagttcctaaaaaattaactcgtccgctttcgattgaagttcgaggagaatgctttatgcctaaagcttcgtttgctaaattgaatgcacaacaattagaggatggaaaaccagtttttgctaatccacgtaatgcggcagcaggaagcttacgacagttaaatacaaatgtaactaagaagcgggatttagacacatttatttatacagttgtggattcaaatcaattaggggccaaaactcaacatcaggcaattcaaatgatggctgaattaggctttaacactaaccctacccaagaagtatgtgctaatttagatgaagtttgggattatattgctaaatacgaaggtcaacgggaaaatttaccttatggaatcgacgggatcgttttgaaagttaatgatttaagccttcagcaagaattgggacacacagttaaaattccgagatgggaaatcgcctacaaatttccaccagaagaggcagctacagtagttcgaaatattgaatggacggtaggacgaacaggcgtggtaacccccacagcggtgatggaccccgttcaattggctggaacaacagttagccgggccactttgaataatgtagaccaattaacagctaaggatgttcatattggcgatacggtactgttacataaagctggtgatatcattccagaaattacacgagtagtgttagaaaagcgtccagcaggaattagtgagttagatattccaacccaatgcccatcatgtggtaaggaattagttcacttaaatggtgaagtagcccttcgttgtattaaccctgattgtccagctcaaattgtagctcgtttagagcattttggatcacgaaatgcgatgaatattatggggcttggaccaaaacaaattcaacaattatacgcgaagaattttattcatcactttgacgatttatacaaattaacttcagaggaattaagccaattagatggttttaaagagaaacgtgttaacaacttacttgaagccattgataatagccgaagaaattctttagagcgtttaattaatgggctagggattcaaggggttggtacgaaaatggcgcgtactttagcggaaaaattcggaacgatggataatttgatgcaaacaacaattgaagaatttgatgctgtagatacgattggagaaaccttagctaataatttagcaacattcttccaaagtgatgtagcccaaaatatgattgatgaattgaaggctgtcggagttaatatggaatatttgggtgtaaagccagctgaaagtcctgatggttattacaaagggaaaaaagttgttttgactggaaaattagaacagtatacacgaaatgaattaaaggagcgtttaattagtttaggtgcagatgtggcgggttcagtttcgaagaaaactgatatcctcattgcaggagccgatgctggtagtaaattaactaaggcacaagctttaggaatcgaaattttagatgaaaccgaagctattgctaaatttgaacaataaaaaaatgggatttaatcccatttttgtttgtttttgaatacgaccattttactaaacgcatagtttgaaatgacaacaacgacattatcaataattttcacgataatatcgtttccgtttagaagcgtaattccaatatataaaataataatatcaattgctaaagtggctgttcgcattaagaagaatcgaactgcttcggttacaagttgaccagtagtttcagtatgagaattaaaaacccaaagtttattactaacataagccacaagcacggaaacaaaccaagcaattacattactaacttggtagaacagatgtaagtaatctgatagaatggcaaagacaccaatatttacgatggtggttaccacgccccaaaagagatatgatataacagacttgtacttgtaaaatagttgattaagcatgatgtcatctccgaatcattgtaaggttaacttattaagtaaaacatgaaagtacaaaaaaagaaagtttatttaatagtttggataggtgaagtagtttgaaaaagttatcaataattgttccagcatataatgaagaggagacagtcgggttattttatgacgctttctctaaagtagaatcacaaatggatgtagaaccagaaattatttttgtagatgatggttctaaagataagactttaatcgaattaaaaaaattacaaaaagagcatgaagaagttcactatattagtttttcaagaaattttggaaaagaagcggccttgtatgctggtctccaaaaagcgacaggagattttgtagcagtgatggatgttgatttacaagatcctccggaactacttcctaaaatgcttaaaattgtcgaagaaggcgaatatgatgccgttgccacccgaagacaagatcgagatggcgaaagcaagattcgttcattcttcgcgcgcatgttttataagtggattaataaggtaagttctttagaattagttgatggtgctcgggatttccgcgtaatgactcgtcaaatggttgatagtgtattatctatggacgaacgtgaacgtttcagtaagggactttttaactgggtggggttcaatacctattacatttcctacgaaaatcgtgaacgagtagccggtagtacatcttggtcattctgggggttacttaaatatgcgattgaagggtttatttcattttcaacagctccattgtcgtttgttacttctgcaggggtactaacgtgcgtgttagctgttttgggagctatagcagtggtgattagggcaatcttattcccacatacagcggcctttggatggccttctctagcagtgattatattgttctttagtggggttcaattgttgagccttggtattatcggacgctatattgccgaaatctatttagaaacaaaaaatcgtccaatttacattattaaggaggagaagtaatggccagccgaagacccttactactgacgctgactatttttgtgattaccgcgataattgtaacattaccggccttcagcggaaattttctaaagctgacaatggatggaggtatccatctttcgagattggaatcagttttcggggcattttctgttggtaagttgccacctctggtgaattttataggtctaggtgatcatgttaatgcatttaatggaatgtatccttggttttccacagcactattttttacattgcctagattaatattgggaagtccaatgcaatcaatgtttgcaggatatgtactgttgaacttagtaacaatgttgaatgcttatttgctggtaaaagaattaagttcggataatatagtacaaatcttttcggcaatattttatggagtaaatgcatatcatttaacattgttattttctagagaagctctaggtgaggcggttgcttatacttttgcaccattggttatgttaggatgtttgcgaatttggagtggaaaaaataagggaccggtttatctcgctataggtatggggatgattgctaattcccatgtgattagtttgttcctaatttgtctactattaatagtaatagaatttacaaggatttttttcaaaaaagtaaatttaatcgaaataaaaagatttctaataagcggattaatagctgcattaataagttgctactcactacttaatattgtaaaaatagccagtactaataagatgtttactcctactaaaggattagcacctgtaatcccatctaagatggtatctacagtattagataatagcatacaagatgataggtatatatttaatataggattggttggattaatattaattatattcttatgtgtagaactatttaaaaaagataaaataggtaattgggtgccatggaccgtttttgcagtaatattatttatttgtacgacatcttggttacaattagagaatacaagattaaaagactctgtttttggaaatatacaatttctaggtaggatttcagctttaattgtattattaataactatagcaattacgatttatttagaagaacaaaaagtacacgaaaaatatattctactaattataagttttttattaattttaatgggtgtcgatagtattttacaatttcatttaaagaaaaatgacgatccaataaggttttatgtaaaaagtgatgaaaattttgtcagaattgcgcatgagcaaacacatggtttaagagattatactttggtggacaaaaacaacaataatattctttatatagaagctaatactggtataaaaaattatagtggtacatctaattcagcaacatttgaagttaaagctaaggaaaaaataactactgtaccgattaatatgtataaaaatgtagattatcacttatatgttgacggaaaaaagaagaagtttcagtcagacaaaaaaatattgactatcaatttgaaaaaaggtaatcataaaattaagttagtatcaaaggcaaggtatagtgaatatattagtatgtttgtatcctgcgttagcctaataggctgtggattatttataatattgatagagccacgaaaacattgaaagtgttttgtagataaaaaaccataacgattagatatataaatctaatcgttatggttttttatcttataacttagttgcactaactagctaatacgtttttggcgttaaaccaaaaactttcatgatcaataataccattaatccaaactccgcctgtatacaagtttgaagaacggaaatctctaggtgtaagagtggctatttgttttatgaatactggttcttctcgttcagagagatcaatattcttaataaatttagttcctttcactccaggaattcctgaccatagaatcgtggtatctttaatttgtatttgatcgccaacaactagactatcactattagttaattgctgaagttcataaggaggtttattttcgagaaccgtttctagtaatcgttctgttgaatggccatcttcccatgaagcaaatttttctaagaaagctcgatactgatcgttgtcaatgaatttagtaggctcggttaaagcctgttgaaccaatggaattaactcttcattagtttcaacgactggaccaggaaccgttgaattgtaatccatataaaaaccacgaatatcttcagcatatgcttttaaatcgtatgcaaagaagatcataggacgtctaagaatcgaataatcaaaaaatacactggaataatcggtaatcaaaacatcacttattaaatataggtcggtaatatcttcataatcactaacattaataactcgattaccatatttggttaaatcaaggttattagcaattagataatgcgttctaactaaaattaaggtgttttcaggtagatctgcaattaatttatctaaatcaaggtgcaattcagcgcgatagtgatctgctcgtacaaagtcattgtcacgccaagttggtgcatagaggacaaccttttgattatgagcaatatttaagccatcttttaatagattgatatcatctttagttgcattacttaaacgatcattacgaggatatccagttgggagtagctgtggatattgctttctaaaggcgcgttgcatgatttcgtatgaatatgggtttggcgttaataggtaatcccaacgcgctgaatcccgtattacttgtttatggtatttcatccgagttactccaggcatagtgacctgctgaacgtcagttccaattgtttttaagggtgtcccatgccaggtttgaactactactgtatctttaggtttaaaccatctaaaaggacgacgaacattagtaaaccaatatttagcgcgtgcttgaatccaaatacttcttaggctaaaccttattacataggggatgttatgctttttaaagtattcctcgtagtctttattgacattccaataaagtttaatttctggataattttgtttcatgtattcataaatagcttttggattgtcagaatattgacgtccaaagaagctttcaaacattgcaatatttgcctttggtagaagttgtccaagaatatttaataatttgtgttgtatgttatttagttttaacaaacgttggatttttgagcgtattagattattttctactgatgattggttttcaggttttaagctaagcatagcttcacttaaacgttgagctgcatctccatcgcgcccatattcacaaaatttatcataaaattgttgaagtttatcagaatattttacttttacatcatcaatgtgtttgagcgaattaactacatcagcggtagttagtgcaaccggtccgggaaccgtagcatcataatccatataaataccacggttagaaggatccaagtaccaatctttatcatatgcgaagaaaatcattggttttcttaagtaaccgaaatcaaacattacacttgaatagtcagtaatcaaaacatcactaatcagatataaatcattaatattgttatagtcactgacatcataaacaaatccagaattattcaagaaattttgtgaatgagatacaaagtaatgaagacgtacaagcaggacgtattcatcactgagttctttttgcatcatatctaaatccaactcaaaattaaaagcatcttttgttgtcctatacgtaggagcatacaaaataacttttttgttgtccggtaaatttagtttctttttaatagaggctaaatagtcagtattattattggtaatcaactcatctgtgcgaggaaagcccgttttcagtattttcttttcaggataatcgaatgcggcagatccatgtttcagcatgaagtcagaaggcacggacattaaatcccaacgaccgattcgcttagcgaaatttttctgaacacgattcgatgcatttttaaaatgaggttcgtcaaagcccattaccttcataaatgttccatgcagagtttcaacctcaatttgaccagctcgcttagaatactgatttggaaagttagtattttgaacaagatacttagctctggccatataataccagtatttaaaggacatctgacgaactcgaattgctggtccctcaactggagtttgttcattttttaggatccaaacgaatttcatattaggacgttgtttggataaatatttatacatagctcttggactgtcgttatatgattgaccccaaagactttcaaataaaacagtgtctttttttaagggtaataatcgcattaaaggatacagaacggaataagttaaccctctacgaatttttgtccgatcaatccaacttttggtctgattaatattaagcttcaaaaaaccgaatttgtctaaaagaacggtagaattagttcttttattaatcgaatgattttgaacaggtatttgtacaggattaatattagctaatttaaatctgtaagaaatatttttagaatctaaaagatttagataaatatgatattttccagaaagaacgtttaattgtgttgggtttcccaagggaattgtgccaacgattttattgcctaaaacagtagctgtaccaccatttagatagcgattgattaggtcagatgatagtagttcgatttttcccgtagcgttcaatttttcagtagatattgaggggattacctcaaattgaagggaaacagcattagaattcttagtaaattgtacattattagctggagctatcgaaacatcaggtctaatccataatcccttagctggattaattgaaagtgcaacacttaaagtagagttgtttagtaattgttcagtaattttaaaactaggcaaaatcgttagtccagtctgagtgtttataaaattaactttacaactctgattaaagtaattttttaaaaaagttgattcaatttctaacttgaaattaccgttattatcaaaagaacaaggtaatagagtatcttgaattttagcagttaaatttaattctgaggaagatccgctgataattagactaccagaattggctaatttaacatctgttactgttgttggaagtttagtacttccaattgctaaatcggaagtcggaactgccttaatagtggtttcccaattggtattatgtccgtagataaacgaaatatcacctgttgggtcagtaaaagttgaaactgatccagaaccctttttaggctgtcctaaatagactgaaagtaacttagagcttttactttttttataatcaatcttaattttgtaagttccaagcccaagcttttcaacgtatttaactgggttcactgaaaaactaaatttacttgcaggaggcgtcatgcgttttaaatggaaattaaaaatggtaaaaggacgcgtaaatgtattgattttaacttttttacccgtagcaatattttccagatatacattgacgatttcttgcttaaaaggaaaatgatgaggagatttttttcctatttgtaaacttccagcaaaattaagctgttcgttcaaatattttacctttgttatccgaacctttaatgatgcaggtgtatgaaaaataggaatgtttcgattctttctatcaagatttgccactttaccattcaatggatggccaaaagataattgttttaaaaggttaaaattaccggtttttaatgcaaagtattgatactgctttttagcagacaacagtttgatgagtggtgtatctaacaaatcccactctctaaaaaatttgatagtggcctcttgaaacgcataaataaaagtatcatctgcatcggcaatatcgtccatgaataatggaatatctacgtctaatagtttgaataacaattggcgcttactagaaccgtgccaaagcgaatattgttctaagatgttttttacttgatataaactttttaagcggtcgaggtatctaggtaattcattttttacttgagtaaaagatgaattaccaccatcacgccatctccatctgtatacaacattggtgaggatatctataccggaactcgctaaaaatgcctttgaagtgaaggaaacatcttcataaatttgattaatgggaaatttaatattttctctcttgagaacttctaatttatacaacttgttccaactggtagtgtcatataaaagttctggatgttcttttagacttgtgtgtttgtaatcatcaataattgcttttttgtgaagataggaaggcttatcacgactcttatcaaaccggcgcacaaaacctgtcacaatttcggagcctgaattcatagctgaaagcatcatcgtagaatatgcattggatgggacgatatcgtctccatctacaaaggcaatccaatttccagaagctaaatcaatgcccttgtttctagaggcactaggacctgcgttttcaagattatgaacagcaataaaattaggatgattttgagcatactcatcgataattgaaggagtagtatcgtcagagcaatcatcaatcattattacttcgattttttgaaatgtctgttctgctagagaatctaggcattctcttaaatattcagatacattatagcaagcgacaattacacttattaagttatcttgccggtttgctttttctacgtttttcaaaatgttcacctttacctaagttgtttaatatttatgtgtctaataatgtattataatatacgttattggtttttacataattttagaaaataagatttttaaaagtttagtaatactgtttaattacttttgaaattatagtaaagttttaaattagttatatttattaaaggagcaatacaaacgatgaatacaatgttcaaaataattagtgaccaattcactaattttaagataattcgacggatggctaagtatgatgaccgtgctaattatcaaagtcattatctaggtttagcttgggaatttttgaatccgctgattcaaattggaatttactatctcgtcttcggggtggctttgaagcgtggagatccaatgccaggagtaccatatttgccatggatggtgatgggaattgctccttggttgtatatgaataagacaactttagatgcttctaaaagcatttatcaacaagttgggctagtttctaaaatgaaatttccaattaacgttttgccatctattaaaattatgggaaatttatatagtttctggacgatgatggcttttggtgtgtttttgatgtttgttaatcgaatttggccaaccatttcatgggtccaattcatatattattttatttgtatgattgcacttatgtatgcgttgggaatttttaattcaacagtgagtgtactagtgcgtgattggcaaattgccctacaatcagtgttaagaatgctgttttatatgagtggagtattgtttaacttcgttacttcaaattttccacctgtattagtacgtcttttagaattgaatcctttttattacgttattaacggaatccgggagtcgttgctttctaagggctgggtatggcaacaaccaaatctcaacttaacgatttcgttctggttgtttatttttattgtgatgatatttggtagttatctacataataaattccgtgctaattttgtggatttgatttaagccgaggagtctaaaatggataatacttataaaattaaattagaaaatgtaacaaaagagtatgacctttttaaatcaaaaagtgataaactaaagaacttttttaatattgggaaagtagatgttccacatttctggtctttaaaaggtgttagtctaacaattaaaaaaggggaaacttttggaataattggagtgaatggttcaggaaaatcaaccatttcaaatattatttccggaatcattcctcaaaccacaggaatggtcgatgttaaaggtgatacttcaattattgctattggcgctggtttaaagagaaacttaactggtgccgaaaacatccgtctaaagggtctgatgcaaggtttgacaatcaaagaaattgatgaagttagagattccatcatcgattttgccgatatcggtacttttattgatcaaccagtcaaggactattctagtgggatgcgttcccgtttaggatttgcaattgcggtacacattaaccctgatatcatgattattgatgaggcattgtctgttggtgatgatactttctatcaaaagtgtgtggacaagattatggaattcaaggaacaaggaaagactattttgtttgttagtcattcccttaatcaagtaaaaatgatttgtgatagagttgcatggatgcattttggagaactacgagaaattggcgagacagaggaagtaattgaacactaccgtaaattctcaagtgacttcaaaaagaagacggccaaagaacgtaaaaaataccaacaagataagaaaaaagagcaaattaaatttaacatagatgagtatcgtaagtctctaattgaagatgaagtcaagaagggcatcgataaaaatcaagcagaaaaggatgtacaggaaagaatgtatcatcaaataactccagacaagatgtctttgacaaccaggattgttactggaatagcaatattaggacttgcattctttgcgttggtaaacatttctggccactcagttactaattcgctggaacatccaacaacgttaatgcatccagtacaacataaagttaggtaattttcatatcataaatttggaagggtttaaaaaatgaaatttaaagaaagaactatgaagaatcctaacgttgggacttttttagttattttaattactggattattactaacgatgcctcaaattttgaataaaagtattatattaggggcagatgctatttttcactttaataggttgtacgatatcgcaatgcaatttgatagtggtaattttagttattttacatctaattatggttttcaacaaaccgctagaattgtgaatgcggtatatggtccaggactggcatatatattaggttttattttattcatttgtaggagttggttaaaatttcaagtaatatcatcattattattatttctgatcagcggctatacaatgaactatttatctactagtgttggactatctagaaaagtagccaatatgaattctatgcttttcatgagtagtttttgggtaatgggttggacagttagccagatgtttatgccgtgggggattgctgtagctccactaatcgtcgctgtgggtattaaatttattaagagtgataaatttacgattgttgaattatctatctccgtttcattgatgattcagatacatatgttaagtgcagttatatcggtctttatattgtttctattctttataattggaattataaatgtgaaagataaacttacactatgtgtaaaagtgattgcggctgctggactaactttattgcttacatttaatgtgtggggatcaatccttgaaatatatattgggaataaattgtatcctccttttgctgcaaatttagcaatgaaaactatgaatttatcggtaggcaatgctgattttaaccatattggaattattgtaagtgtattatttgcttttgaaatagcgattactattatgaactggtcgatcttatctctaactactaaagctgtaactggtatagggacagtgatgttagtactttcatctaatattatgccttggatggttataggtagaaagatacctatgttaaatagttttttacaatttcctagtcgacttgaaggtttcgcatttgtattgttgctggtaggtttaggtttatgtattgaggaggttaatgaaccttcttttaaaaagtatactaagctttttttaatgatagcaacacttttttccgtagtacaatcttactataacgtacagtcaaaaagtgaaggctggaatggtcatcagccgatagcaaataggactaatgtaatagttaaaaataatgcttcagaaagtgaaataagaaatgcttttaggagtaacgacttaagtaaaggtattgagctggccgaaaaaccgacgacggactatgtaccaattaatgttaataatactgataatggcaaatcacagagtgcctatgaaacatatgcagcattgtttattaactcaaaacaaggtgtaaaaaaggaagttaaaaatggaaaattaatagtctcgtggtatgcaaatcataaaggagaaagtaaaaaaataccaattaccgtttataaaaatacgatattgctaatgaatggttcaaaattattaaaagggaatatcacattaggcacgatgaatatgccaactataaaagcaacccaatctgggaaaaatgtattaacagttagctataaatcaagctttattaatggatggaccatgattttaactggtctactatggtttagcataacggcatttaaattagtaatgggtagaaaaagataatttaaaaatactctaagatttaggacgcaatttaaattttagagtatttttagtatctatctgtaaggggagcaaaccaatgaaaaaatggatttatacctttattggtattttaatgtttatatgtatagcatgttatatcgttactttaaaaaagggagatacagttgtttctaatactaaaacaaaaacagccataacaagaattgtagatagaaaagagtctggaaaattaaaaaaaagtctctcgaagactaagtttagcggtacagcggtcttaattaagaacaacaaaatagtagatagttacgtatcaggatctgccactgatgttgataaaaatatgttaacgactacttatgaaatagactctctacaaaaagttttaacagcaggtttagtaatgaatcaagtcaataaaggaaagctaaaattaactgatagggtcaataagtttattccggatctaccaggttctaaatatataacaattcgagaactacttgatatgaattcgggattatcaatgaaaaaaatgaaattttcggggaataatttatctagtgccgaattgctagatgttgtaattgataatgttaggtttgatgctaatacaaaaaaaagcgggaagtggagttaccaaccagtcaattttgtgattttatcagaaattcttgaagaaattacgggaaagagctataaacagctgtttgatgaaacttacgtaaaaaaattaaagcttaagcaaaccgaatttgcttacgacgataatatagaaactaatcgagcttatggatatgtagttaaagaaaatggggatagaattgaacaaaagcccaatggtgcgaccatcttttcagagctaggaactggtcaagtatatatgtctgcaccagattattataaattagtagctagtctattaaatgggaaaattttaggaacagacgcagctaaagaactttatttaccactaggtaatggtaaatatcgcgctggtctatatacatctaagaaaccattttatagatatgctaatggttatggatatggctttgaaagtcatgttcgtattagccaagatggaaagaaagctgttgttgtatttagtaaccatcaagtgagtggtaacaatggtctaaagaaaaaagttgaccagttatcgaagaaatttttaggttataagtaattagaaaaagcatggaaaatagttccatgtttttttgttaataaattattcaagttttatgctaactgaaatcataaaaatataatatactaaattgaacaactaagattgagaaagatggagtattatgtacttaattaattttttgagaaaagtaaaacgccgatttttagtttatttatttaacataaattacaaaccttactcacagcctaccatcatctttgaaagctttggtggacgtcaaatcagcgattctccgttagctatttataaagagttgaaaaaaactcatcctgaatatcgtttgatttgggttgtaaataagggattagcaacccaggcagagaagaacggatatgattatgtaatacgtggctctttcaaatgggttcgaacaatcgaaaaagcccaagtttgggttgaaaatgctcgtttaccgcagtgggtgcggaaacccgatcacataaaattaattcaaacatggcacgggacacctttgaaaaaactcggattagatattaaaaatgttgtgatgcctgggacgaacacggaacgttatcatcaaaattttgttagggaagccaatcgttgggatgtattaattagtccaaatacatactcgactaatatttttcgacgtgcttttggttatcagaacaaaattgtagaaatcgggtacccacggaatgataaattggctaatcccacaaaagaagaaattaaattattaaaacaaaaattaggaattcctttaaataaaaaggttattatgtatgctccaacatatcgagataatcaattttttcaaaagggtaaatattcatttgaattaccttttagtttaaaagaattccaagaacgatttggaaaagatgcagtacttttacttagaatgcattatttaatagcgaattcaatggatatttcaggatttgaaaattttgcatacgatgtatctagttatgcagatatttctgaattatacttagtatcggatttattaataacggattattcgagtgtctttttcgattatgcctatcttaaacgaccaattttgttctatccttatgattatgaaatttataaagatgaattacgcggtttttatttagactatcaaaaagatctaccgggggaaatcgcctacaatccaatcgagctttgggataaaattgaatgcggactagctcagtctaatatgagcatcgaccaacgatttaatactttttatgatcgcttctgcaagattaatacgggaaatgcatcaaaggagattgttgaagaaattagtaaatttatttcaaagtaaaacaaaaaacacgttgaacttcaaaagttcagcgtgtttttattagttgtaattatttcttagcttcttcaatcatcttctgcatcatttgagcttgatattgagcagcatattgtttagaagctttagccgttgtatcagccattagtttcttttgatcactagcactcattgcaggattcttcttaagtgcggcagccattgttgacttcacagtagctgtgaccttagctttaacatacttttcagcatcagctttcatttgagcttgattctttttaacgttcttttgaagcttagcggcttgttctgttgataaggtaatccaattattaggaacgtagaaagtattaacacgttttgaaacttcacggttattaccggcaattccaaaccagaacttgtaagtgttgttcttataagtccaacgggttgtagatttaactaaacgagccgtactctttttagttgttttaaccttgttagtagttttatcagtttcagtatgactaggtttcttttgagaagtagtcttattgtagatataaactcgatctttatcagcggtaccgatactcttatagagtaacatgctcatttgtttagaaggtgagactgagtagatttcttgggtagttgtttcagtaattttatgcatccccaaatgttcacgatcattcattaccatcaaagcaaccgaagcaattacgacgattgcagaaatagcagaacaaataacacggacagctgttttagagataagtgtcatcgaaaggaacgttgcgatgactgcgataattaaaagaaagataatcattatttattacctcctgcttgaggttgtactttggcagtgctacctgctttacgacttacaaagaatgcgatgattaaaccaagggcactaaagccaatggcaatccagaatgtcgcatggtaaccagcaacggttgcgtcaaatgcttgatctttgtaagcgagtggttgggctgatagaagatgcttaccaggcatttggttcttggtaacgttggtcaagacactaaccaagatggctgttccaacagaactggctacttgacgaagagtgttattaaccgcagtaccatgacccatcttttcaaatggaagagagttcataccagcagttgttacaggcatcattgccatcgcaattccggccattcgaacagcatacaagacaatgatataaatcattggtgtagtcttagtaatgaaagcaaatggaagcgttccggcagttaagaggaacattccagtgattgctagacgacgggcaccaattttatcaaataggcgaccagtaataggacttaggaatcccatcattaaagcaccaggtaatagtgttaaacctgaatggaaagctgattcgccacgcacggtttgaatataaagtggaagtaccatttcagcccccaccatggcaatcattgaaactgaacttaaagtagcagaaattgaaaattctggaatctttagcacacgtaaatcaaggaatggtttttctaatctcaattggcggataccaaataaaataacaaagataacaccgacaattaatgtagtaataactactgcgtcgccccagcctttgtctccaacttcagagaaaccaaatagtaaactaccaaatccaattgtagataaagcagctgaaatccaatctagcttcttcttgtcggtttccaaaacgtctttcataaataatagaccagcgattagaacgataaatacgattggaataatcattccgaatagggttctccagtgatagttatcaataatccatccagaaagagtaggaccaattgctggagctaccccaataactaatccggcaagacccatggctgaaccacgttggttagctgggaaaattgtcaacattagagtttggaggagtggcatggtaacaccaactccgagagcctggattaaacgtccggcaagtaaaacttggaacgtaggagctgtgtaacatagaatggttccaattaggaaaacagccatagcagataaataaagtcgtttagaaggaacacgacttgttaaccaggcactaatgggaatcatgataccgttaaccatcagaaatccagttgtcaaccattgaacagtagaagtactgatatcaaaagcatccattaatgtaggaaatgcggtggttaaaattgtttggttcaaaacggtacaaaaagtacctattaatagcacaaggatcaataaggatctcttatagggtttaccatgtgcgtcaattgcttgtggcataagcttacaacctctttgcaaaaacttttctttaatactataagttatcataacgtctttgtcaacttgtttgacaaagatgttagagaagttataattagtttaaaagaagcaacaagatatacagcattaatgaggaggagcaaacatggaaaaccccgcgggtcgcctagcagtggtaaagaaaataattgatagcgaagctatgttactcagtattggtgatgtggccaatgctgtcgatgtatcaactagacaattacgttattgggagaaaaaaggttatattaagtctaaaatttcaaaaacaggtcaacgaaaatatacctattttacgatgattcaagctggtaatattgctagctatattgaagatggtttcactttagccaaagcagctgaaaaagcgcaaagtaacggacgcattatgaaagcgttacgtcactttcttaaagaacgttttagtagcggtcgtgagattcctaatggctatgaatttgacttaggtgaaattaagggtttaccaaaagatcaacgtttgtttatcgaagtgctagaagatggggaaagtttttttcaagttaaaaaagaaagtacaaatgattgacgaataagctatttgtactatatatttattaatgaaatacttacaaaaaaataacggttcatcttcaaggggcagggtgcgattcccgaccggtggtaaagtccatgagctgtcattcgtgatggctgattcggtgaaattccgaaaccgatagttaaagtctagataaaggaagattgaatttatttgcgcagactaacgtaataataaaacagtctaaacaccaatgccccagttgcattggtgttttttgtgtaaataaaccaagaaggtgctcctaaatccaaggaggcagtatgatgagtgtttctaaagttaataaaatggttgtagtcgctatgctagcagctatctcgtttgttttgattttcattgattttccaattttacccggattttcgttcctaaagattgatttcgcggatgtcccagttttaattgggacggtattatttgggccagtctgggggatggtgacagctggtttagccggactgatggatataatccttcgagatagtaatccagcaggtgcattgggtgcatttgctaactggttggcagctttgtcatatatcttaccgatttactacgcaattaaagcggttcaaggtagcacgcataaaaaagaagcgggggccttgattaagggtgtcttaatcggttcggttttgatgacggtatttatgagtgtgataaatttattcattctattgcccttatatatgaagttagcaagtttccaaattaatgtttcgaccttaaatatggttctttatggtgtagtaccttttaatttgttaaaagggattatcgttggaattgcaattggattggtatattttagattaattccgattatcagaagagcttcaaattaaaatggtataatataacctcattagtttagtggggtgaaatttaatgcacatcgaagctcaaagattaacacgtatggcattgctattagctatagtcattgttttgggattaattccagcgattccgattggtataattccagtaccgttgacagttcaaaacattgggattctattaattgggttattgttatcgccgtttgaagcatttttaacaacaggagtatttttattgttggcgttaataggactacccattttgactggacttcgaggtgggatgtccgtttttatcggacctactggaggatatctcctaggatattggattggggccgttttattagcttggtggtcgaagaagcatcgccatgaatggttcttgctatttgcaaaaattgcgactgtagctgtcttaattatcgatttgtttggtagcatgggctttgctgttaatatgcacattccactaatcagagctgtagcactcaatagccttttaatcccaggagatatacttaaagcaatcctggtagcaacgattgcatacaaacttaaataacacataaaagctagaaattatttagtaccgctggagacagcggtatttctaatttttagctttttttaaacttttttaaaataagtgtcgaaaatgctgtattgatgggaacacttcttaaaaaccatatgaactttatgtgataaatatgaatttttttagcccgttatattacaggaattttacaaagagcgaaaaaaatggcatacttttacgtaacgcaattagatttttataaattcactatcaaattagtgaaaattagcaggggggattgtgatgctgaattttttaaagatttatggcaacatgattcagtaaaatttattacgcgaactgttttttactttgcagttttagtcgtcttgttgtacttgtacgattacagcggaatgactggcggaacatttatctataacgaattttaaacgggggatttaattaattatggggaaagtaattaacgtgattgagcaaattgattcaatcgcagttaaacatccagattggattgcttatgattatctaggtactaagaacacatatggagaattaaaagcttattcagatagcttagcttcatatattttaacgcaagggttggaagaagatgcgccaattatggtttatggtgctcaaacctttgatatgattgcaacttttttaggggttgtaaaaagtggacacgcttatgtcccaattgatcgccactcaccagcagaacgattaacaatgattaatgaaattgctaatcctgggatgtgtatcgcggttgaagatttgcctgtaaatttgggtgatctaccagttctagaaggacaagaattaaacgatgcttttaatgcaaataaaaatgtaacacctaatagtttcgtcactaaagatgataattattatattattttcacgtctgggacaactggtaagcctaagggagtacaaatcagtcacaataatcttttaagttttgtgaattgggaaattggcaatctaggtttacctgaacgtccagtgacgttatcacagccaccttactcatttgacctatccgtaatggatttatatcccacattagttatgggtggaacaatcaaagcggtgcccaagcaagttacggatgatttcaaaaaattatttgaaatattacccactttgggcttaaatgtgtgggtttcaacaccatccttcatggatatctgtttgttgcaaccgacttttgatgcagaacatctaccagcattgagccgattcttgttctgtggtgaagaattaacacacgctactgcgcaggctcttaaactacgttttccagatgcaaaaatctttaatacgtacgggcctacagaagcgaccgtcgcagttagtgcaatcgaaattacagatgaggtacttaaacaatatgatcgtctaccaattggatatttaaaagaagatactctgggatttatccttgatgataatggaagaatggccaatgctggtgctgaaggagaattagttctatcaggaccaagtgtttccaaaggttatctcaataatccggaaaaaacggacgaagccttttttgaatatgaaggtcaacgtgcctataaaaccggtgatttagttaagattgatgatactggaatgctttattatcatggacggactgatttccaaattaaactgcatggttaccgaatcgaacttgaagaggttaaccattacttaaataacgatccattaattcaggctggagtggcagttcctaaatatgggaaagaccaaaaggtggctcaattagtggcctatgttgttcctgaaaaaaatgagttcgattctcaaattcaattaacagttgcgattaaagatagtttgaaggataacatgatggaatatgctgttccaaatcgctttgtatttgttgaaagtttaccgcaaacggccaacggaaaaatcgatattaaatctgttattgctgaggttaatgcctaatgctttcattaacaccatatgaaaatccaatgtattttggcatgctagctgtggcatttattcccattgttgtaggaatcctttggggcaagaggtttcgttggtacgaactattagtatcaatcggattcattctcttatcctttggaggacctaagtgggagcaaggcgttgcactagttggatttttaatttttgaagtgattttagtttcactttataacgtatatcgtaaaaagaaaaacgacacgtgggtgttcgttattgcggttcttcttgcgatatcaccactagtggtcgtgaaattaacgccattgatgtcggggactccatcgattattggattcttggggattagttacctgacctttaaagctgtacaaaccgttatggaaattcgcgatggagtgttaaaggattacaatccgtggttctttttacaatttatggccttcttcccatcaatttcatccggtcctattgatcgttatcgtcgttttagaaaagattatgagagcgttccggaccgcgaaaagtatttaaatatgttggaaaaagccttacattacgtattcttagggtttgtctacaaatttatgttggcatatctctttgggacaattttacttccaaaggtacagcatttagctttgcaatcgactggtctgtcgtgggggctggtaggagtaatgtacgtatatagtttctatcttttctttgattttgctggttacagtttgttcgctgtagcaactagttatttcatgggaattgaaacaccaatgaacttcaatcaaccatttaaatctaaaaatattaaagaattttggaatagatggcatatgacactttcattttggtttagagattatgtatatatgcgattagtattctttttcatgaagcataaaatatttaagaatcctaaaacaactgccaatatcacctatgtcttaaacatgttattaatgggtttttggcacggtgagaaatggtattacattgtttacggtctaattcatggggtagccttagttattaatgactggtggctaaacttgaagaaaaagaatccggatcgattcccacataataaatttactgaatacttggcgatttttattacgtttaactttgtttgtttcacgttcctcgtattttcaggatttttagacacattatggttccactaaaaataaaggagaataattaattatgaatacaaaagaaacagttttaaacattttggcagatcttacaggttcggatgtaagtaatagtatggatgaaaacctttttgaaacaggcttgttagattcaatgggtacggtgcaactattactccaactccaaacagaattgggaattatggccccagtttcagaatttgagcgcagtgaatgggatacaccaaataaaattatcgctaaagtagaggcaatgcagtaatcgtgggtaaaaaactttggatgatatttggtccattgctagtcgcatcagttgttttgattgggcttttattttccccattcaaaataaaccgaatcagtccaacaattgagaagcaagccgcgacatcattgtcaccaaatattttaaagggcgatgcagttaagcgagccgccttatcagatccatattatgtaccatttttcggatcgtcagaattttcacgctttgatttgacgcatccctcagttatggcagaaaagtataattgggatttccgtccattcttaatgggagcagctgggacgcaatctttaacgcattatttccagatgcaaggaatcaatcaccagcttaaaaatgggaaggccgtatttgtgatttctcctcaatggtttgtcaaaaaaggggctaatcctcaagcattttcattttatttctcacaactgcaagctgttaactttttacaaaagcagcatggtacaagaactgatcggtacgctgcccatcgcttattaaagatggaacaaaacactgataatggtaatggaatgattaacaaagctcttcgtcaagtagcacaagggcaaaaattatcagcaagtactcaacgaaatattagttattacaaacgtttgttagctcacgaagatcaacttttctctagtttgaaactgaaagatgataatcaaaagaaaattaatcgccagctgcaagctctaccaaatagtgaatcgggagatttaattcgccaagcgattatcaaacaggccaagcaacaaacatcaaataatgattttggaatcaaaaattccttctacagtcatcgactgaaagataaattgggtaagtttaaaggatttgaaagaaattatgactacactaagtccccagagttcgcagatttccaattggttttaaatcaatttgctgctgataaaactgatgtattatttgtaataccaccaattaatcaaaagtgggcaaattatgctggtttatcacaatcgatgctgaaaggtttcaataagaagattaagtatcaattaaagagtcaaggatttgaccacattgctgatttatctaatcaaggttcacaaccctactttatgcaagatacaattcatttgggttggaatggttggtacgctttcgataaaaaggttaaggctttcgttgatggcgaacaagaaatcccatcatacaaaatgaacaatcagttttatgccaagtcgtggcaaaatttagctccagatgatttaaattcgtatatcaagaataacggttaaattttagttataataaaaggaggttaagtcttaatttggcttacctcctttttttagaaggaagtcagtgaaacggaggaatgtatgaaagaaaaaggatttaagttaattatgcaatttgcggtaatgttggttgcactagaggtgctagcaataagtatcaatatgttctacgctcctcacaatgttgcggccggtggagccaccggtatctcaattcttttagaagatgctctaggttggaatcgggctttaattgtatttgttattaacattgccatgttacttgcgtcgtactttactttgggaaaagaaactactgcaagaattacagtgggtagtttactattaccggtctgtatggcgattactcctagtattagtttagtgtcagatcgaaccttagcagttattgttggtggtgctttatatgcacttggagtagcgctcttatatcaaatcgatgcatctagtggtgggacaacggtacctccactaattttgaagaaatacttcaattttaagccatctgtcagcttgttggtaattgatacaatggtttgtgtgatgaatatctttagttccggaattgaagcatttattttagctttattctcatcggtaattactttattagtaatgaactatattgagacaggtatcgatcgtaaaaaaagtgtctatattatgagtagtcacttagccgaggttgaagaaattatctcggagtctctcgatcaaagctatactagcttagatgtacaaggtggcttttcgggggataacaagcgcatgttgatgcttgtagtagaaaactcagaatatcaccgtataatcgggcggattcgtgaaatcgatccccaggcatttattttaactaccaacgttgctgaagtacatggtggacaatattaatttttgaaataaaaacaagcgataacaaaaggtggtctgaattttagattcaaccaaactttttattatcgcttgttttttatactttttaaaagagttatttagcagattttacaatcctagcggcaatcatatcagccatacgtaagcgaacatcatttacaccaggaattggggcaccattagtcagccaatgccgtttttcagtaggaagcccccacaaaaagaaattaggcatgattttaccgttgggagtaactagttcagccgtttcggtagtgacatctaaagcaccggtcttaaataaagttccgtcgctcaaatacaaagagtaaatgcgagccattttattagcaagcaaatttttaattaaaggattttgagttgtttcagcactaggctgtggtaaccgtccttcgattaaaacattcccagaataacgttgatgatcactcaatacggatgaataagttacaaaatggtcatcttcattttcaacgaccatacctggaccggttaaagtgagcacacctgccttaattagggctaaaatttgctcaattctgaacgcaggcggtcccaccgctaaaaagctatttaatgcgttaaagtactttaaaatatatttcacgtaatcatcgtcacttagtaattcgtaggtgacgattttacgaatgttggaacgtaattcgcgtaatttttcaacagcgctcgtgaaaggagaaactttgttaccttcattagcaatatcaatatcttgttggagataagtttttataaaagtggtaaaggaagtagtgtcagtaacactggtaggaattggattctcccaagttgaccaatccacgcgatctttagcgctaatattgtatttatctagaatttttttgaatccattagaagccgtagccaattctttttcaaattcaacggggttaatatcagggtatagtaacttagctaaagtaacgtagtaagttaattcgacgtctaacgtaatacgcttaataaattctgatcctgtaattgattgatttttaagcaccaggttattaacatacgcgtctgatagaaaataacgtggataagtctctccaacttttttctggtctaaaccacgagcatggtaaggaagtcctcgacgagagctagcgtagatcgttggttcatcgccataacgtgtataaattaacgaaccccgttcatcacgctgaaaaacaccaccacgacgttcggttagttcggacaggtaatcaataaagcttaagcctaagccgcgaatgataacctgatcagtaggcgcaatgtcatcaacatcaacttcggcgggatagcgaacgggaacgtattttaaatgatgtgcttcagcaaatgcttgagcctctttttctgcgtcacttggttcatccatcccttcgcccagagcggctgaaatagcatctacttggtatgctaactcatctgtaagcaagatgtacttttcattgtcaaatttgacgttatggatcaaatttgagtgaatttcgatactaaaattactaggcatgcgtttttcaacatgttgaaagaaccattgttgataaataccaaatagagcccgagagctataagagtatttagttaaatgatcaatctcttctaataaaagtttttggcgcttaaaattattattttcaataaaatcttttccaagagttgttgcccattcaaaaagagttggacctaaatgagggttgccttccatttgaattgaatcatccgtaaataaagttattttggaagccagagagttcatttttagttcatgattttggttagggttccaaactcgtccacctattccaaatgggtcaaatatgagtattttaacttcatctgcccatttgcgatctaatgcccaataaactagacgttcaaaggccattaaattacgtggaccagcccctattaatgctattttcatcgtgttgtccacctcatttattaattacagctatgatagcacaataattaaatttaccgtagtttcatagttgaaacgtttacatgtaattatacaactatttagaagttaagccatttgaattgacaaaaaataagtgaatagggtattctaataattgaaaataaaacaaggagtaattctatgctatttacgaatactaaatcagtagttgaagcttgcgcatgttgtctaaaagaccacatgttatttggcaggcgtaaatagcggaattattcaacgaaccaattgggattagttgaaccggttaattacactgcggtgtagttagccggttttttgtttgttaaggacgtgatgatatggaatctgaatgtagcgattgtagggtgtttccaagttgatgtgattaaaattaaaggagtagaaaatgaaaaataaaaagtggatcgggtttctttcggttattttagtatcattggtggtattggcgggttgtggagctaaaaaaggtggttatgctgctgaacaaaccatgaatttagcagctgatgctcccttggacacgctggatgtatctaaagccaatggttatggacaaactggaaatgtatttgaaagtctatatcgcctagggaaaaatggtaagacaaccccaggtttggccagcgaggctaaagtttctaaagatggattgacgtggactttcaagattcgcaaaaatgctaaatttagtgatggtagtaaaattacagctcatgactttgtctattcatggcaaagaacgattaatcctaagactaaagctttgtatgcttacttatttgaagggattaaaaatgccgaccaaattaatgcaggtaagatggatccctctaagctaggggtcgaggctaaagatgatcaaactttcgttgtacatttggatcaatctattcaatattttaaagttttaatgagttacccactattttcaccaattagccaaaaggctgttgaaaaatatggtaataaatatggaacgaaggcgcaatatacggtttattcagggccttttaaagtaaaaggctggacaggaacgaacgatacttggagtttcgttaaaaatccacaatattgggataaaaaagttgttaaattggatcaaattaaatttagagtggtggaaaacccacaaactaagttgaatttatatcaatccgggaagctagattatacacagctttccagtgaacaagttaaaaactataaaaataataaagattacaccacctttccatattccattaccactttcttacaatataattttaatgatgcagataaaaccaaacgtaaagcctttaacaatgtaaatattcgtaaggctatcgcctattcaatcaatcggaagcagttgattgaaaaaatcattggggatgcttcaacaccaagtaagggcctcgttcccacggatttagctaataatccaaaaacgggaaaggactttgctgatgacgcatatttagacggtaccatcgagtacaatcaaaaacaggccaagcagtactgggaaaaagggcttcaagaaatcggagtaaagaatttgaaacttaatttaacttcagataatgaggggaacagtaaaaattatgctgaattttatgcacagtccttggaaaagacattacctggattacaaattcacattgttaacgtgccatcgcaagtagcatattcgagatctcaaagtggagaatttgatattttagttggacattggggagctgactttaatgatccaatttcacatcttcaaattttacaaaaaaatagtgcatataattatggcaaatgggacaacacggaatataatagccttgtgaaaaaagcccaaaatgaagatgctaataatgctgagaaacgctggcaagatatgattaaggcagaacaaattgtgatgaaagaacaagctgtttcaccactttatcaaactgtatattcatacttgaaaaatcctaaagtaaaaggcgttattcacaacacagcgggtacccaatggaactacaagtatgcttatataacaaattagtaacaaaaatgttttattttaaggagaaagtcccaaatgaggattttcttctttttatattgggcaagggggcgtaatataggtggcaaatactaataagatttttggaggatattatgactaagtataaagttgctttatttgatttagataacacccttttaaaaactgaagatgcatctgtggcagcattaacatatgctttaaaccaagatggcgtagaagtcaccccgcaagcaattgttgaattaatgggtcttccaggaattgatatggcacgcgagttaggttcatcgaatccagccaagacaattgatatttttaacgaacggattaatcaagaagttgatttaattaaggaatatgatggaattgatgaaatgtttgctggtttaagagaattaggaatcgaatatggaattgtaacttctaagcttagacgagtttttgatgatgaaatgcgtagttttcctaagattagagcaattgaaaaagtcgtactttcagatgatacgaaaaagcataaacctcatgctgatccaattgaatttagtatgcagaagtatttccctaagctaaatcgagcggatgtgatttatgtaggtgattcgctatttgatatgcaatcagcgcatgccgctggagtcgattttgccaatgctggatggggggcaatcccagcgaatgatttctctgaagcagaatatatattaaaaacaccaactgatttattagagattgttaaataaaaagaagctgtgaatcaaatgaagaggattagatcctagcatttgtcacagcttcttggtttaatatcggattaaatttgaatacttggtacaagccaatcactagctatcaattgatgaaattgtttagtaattggaagccacattttattattaataatatcttttaaacttttccaaaataaaggatcgttagtttgttcggtggtaggataaacaaatatgtattgtccagcgctggttttggctttgattttgttatctttatggccaattaattgaacttcaaggtactggtccatttttttatcgttaataatcatcaagcatcacctttctttactttttcagaataccatggaaaggttaaggaattataaaatataccaataattaagtgcatcttaataaaaatcacgtttacgagtttttagtgattgtattttatggataaaatgctatctttaaaataaagttggtatcttaaaaaggagtacttaatgagagcgttacaagtgttgaagaactgcctatttttagtattactatttggaatggatcaattggtttctattccacaactagtagcagcatatacacaaaaccatcatctctttttattttttctaataatcgtctatattgcgattgccatagcagttatcgtctttttctggcaattttatcgatataaaattaaaaaaaatcatagtatttatggggatttaccaccaagaagggtgcgaactcaaacaatgctgctaatggttctagtttggatgatttttatgctttttcaaatctggtataccaatcaatttaaagttaatatttctgctaaccaattagcaatcgaaaaactatttgaaaaacaaccaatttggacattcatcgatggcgtgttggtggctccagtcatggaagagctcatttttagggggattttctttgaattatttttccaaactgatcaaccagtaataaaagtaatcggagtgatcgttaatgcagttatctttggtgcattgcacgatacaggaattaattttcctatttatgcaatcatgggcgcaattttagcggttacctacatgcgtacccgtgatattaaatgtagtattggaattcacatcttaaataattttatatcttttatttaataaaaaacggaggatttacatggatagtattttaactaagggaagtcccatcaagggcattattttgttcagtatcccacttcttttgggaaatattttccaacagatttatacgctttctgataccttgattgttggtcgagtagtcggtgtacaagcattggcttctgtcggggcaaccaatggacttacttttttgattattggatttgcgcaagggatgacaacggggttatcgattattacggctcagcactatggggctggggatgttaaggcagttaagcaaagttttgctacgagtatttggatttgtggtgtattcgccttaatgctgacggtagttagtgtactggcggctagaccgttgctagaaatgatgcaaaccccagctaacattattgacggtgccacgacctttttgacgatcatttttggtggtgtgcttgcaactatgttttttaaccttttctccaatatgttacgggcgttgggaaatagtcgtttgccactcgtatttttggtaatcgcctgtattatcaacgtggtattggatattattttgattgtctttttacacatgggagttgctggagccggaattgctacggttacggcccaattaatctcatgctttctatgctggttctatattaagtctcacgttccggttttatcgcttgaagtaaaagaaattaaaacaaatatgaaattggttcgtgaacaaatcaagattggattaccaatggggtttcaggcgtccattatcgcgattgggtcaattatcctacaaatttctttgaaccatcttggatcatcagcaattgctgcttatactgctgctgggaaagtcgatcagctagcaacgcagccaatgatgtcactggggatcacaatggcaacctttacggctcaaaattatggggccaaaaaatttaaacgtattttgaaaggtattcgtcaaacgttgatcacttcggtcgcttacagttttattgtgggtgctttaattattttgaatagtcgcgtactggttaatctatttattggaaattcagaacaacatatcaccaacttggcgcatgaatattttgtgatcgttagtgcgagttatttcttgctagcaatcttgttcatcatccgatataccttacaaggattcggaaagagtgtggccccaacgatggctggggtagccgaattgatttcaaggatgttagtgggactctttgtggttccggcttttggattttggggagcatgtaccgctaacccattggcttggttaggttcaaatttagtattagtttattcatacgttcaagttgtacgacaattgagaaaacgtgctgagccgtagaaaatgctaaaagagcgtgaacacgatataatcgaggtatagaaagtaaatgcgttgggggtagagtgatgatttttacttataacgttctaaagaatgtaattgataccgggaaaccgattatcattaatgatcagagtcaaattaaaaaaatggatagtgatcaaatcgatgcaatcaccttcatttcagaattgagaaatgaaagagattactatgctttcttagaattaaacccaggaaaaggcattgttttttattccgatggtaacacctttgatggctttacggtttttgagatccccttaagtgagttttatttcgaagtgaatacagaaaagggcgtcattgatattgaagacggagttggaaatcaaactgattttctagatctctttacaggaccagttatcgaggatttaactaaaaaatatcgtaatgctactgatgaagaaattatccagagtaatgaatatcaaatggcggatcgttatattagtgtttatctgggctacagcgatggagatgaacaaaaggtcaatttaaccctgttgaaattcgcaatggcgatttatatcgaccaaaatgaatcaaaataattccagtaattttacagtaagattacaactgttgcttttttgattgcagggagtataatttcttctgttccagtatttatggttattttttggaggaagaaaaatgatttttaaatatgatgttttatcaaaagtgatcgaagaagataaaacaatcaaaatcaacgaaaacagctacatcactaagatcaaaggtttaaacggcattgattatagtgtgagtgatcataatcgtcacgattactatgtattcttgccgcttaacgacgatgagggtgtagtaattagcacggacaatcataccggactgggttttgaattgttgagaatacctaagcgagagttttgtttgggaattaatacaaataataattttgtcgattactatgatggaccaggaacacagacggattttcctgatgtaattgaacaagaagaacttgatcaaaagtatattcaatacaacgatgctagtgacgaagaattaaaagaaactaagctataccaacaggtggatacatgtgtaagtaaatacttacgtgttagttcaggtctagaagaagccttgaacttagctattatccgcttagcgttcttggctcatactgttaaccaacgtgcggtggcatagtttatagaacaaaataaaaaggagttatggcttaagccgtaactcctttttattccgctttgttatctgtaggctgtgtaaagtccaagtgatccaaagcattataaaatgcaccgaaaaggtcagtatcctgtttaaaaatcgaagtttcaattaccggcatttccagcatttctttaaggaccggaatcgtttctcgaataatttgaatttggtgattaatttcaggaacgagaatactctgattactaattcgtccactaatgacgtacttattaaggtcaagaacggcctgcgtattcacaatcatgtaagctacatttcgacaatatgcgttaaacatttcgcgagcgttagcatctccattttcaatcgccttaaatactttgatatcgtcattgggatcagataactctaacgcactgccgatggtgttaatcatttttgaggcagaacaggcgttgaacatgatatcttcaggttgatgattttcaaccgttggattggcaataatcatgccaattccgcccgcttgtaagtgggaaccagaaaaaatctggtgatttaaaactaagccagaacttacaccatcatcaagggcgatggttgctccgttagtgacaccctttaaattaccattccattgagaagctaaagtaacacaaaaaccagtactttccatcgacaccggtaattcgtagcgagtggcaaggatttttccaaggctgagtccgtggagcatgggcaacgagcccccctgataaattacgccatctttttggtcgacttggccaggaacactaagtccgattccataaatcgatttaagatggtcagtaacaatttcataaatttgttttagaaaattttcaacgctatcggttggcgttggaacttgtttttttactttaagactgccgctttcgtcaaatagtgcgtaacgaataaaagatgcactgatggcgatacttaagtagttcgtattattcatataatcattcctttgtgtcattattatacattgattgagaacgatttcaaagttacgaatgaggaataaagttttaattagtaaaaaaagacgctatagtagtaagcaataccagactgaagaggtaagactatgaaagtatttaatctattaaataaattaagcaccaaagcagttattttcattattttggtagtagggggattaatttttaaaggaacctacatcgtaagtaatatttattttattttagggatgcttttactattatggggaattttagcaattttattcaacgctcacttatttagtggatggaaattaaatggcaatcgaaaaaacagtgaatttgttgaaaaaattgagcataaagctgtccagtctaaaactgagcgggcaaaagaaattgctgcacaaaaaaacgagcccatgcggttcaccccatttactcgtttaatactaagctatgctttgattttaattgttaatgcgatcctagtttcatttttctagtacaaatttttgaatggctttggcaacgccactttcgttattattggccgtaatgaattgtgcattttgtttaacttcatcaattgcattttccattgctacaccagttccggcagctttaatcatggaaaggtcattaccttgatcaccaattgccatgacttggtctaaagtaaggttaagacgtgcagctaactcagttacagcattacctttgctaacgttttggggcataagttcaataaagtatggttcactttgaacgacgctaaagttgtcttggaacttagcaaaaatctggtcgcgcgctttacttaaaactttaggatcgtcaatgaacattaccttgggcatttctaagttagggtccatttcattaacggcgcgatagcgaagacccatttcaactagaaaactttcacctaccgtataagtgctgatattcttattggcagtgtaaatgtgatttttaccatctacgtggaaatgcacaccaattttacggctaaatgcttcagcagtgagatagtcttcaaaggaaagtgtgtgtttaatgagggtttcgccagtcagagtttgagcgagtgctccattataagtgatggcatattccttttcgttagtaaggtctagttgggtgaggtaacgttgaattcctgtaatgggacgtccggtacaaaggacgacgttaaccccgattttagaagcagcgttgatggccgcgatgtttgcttctgtaagttgtttgttgtcatttaaaagggtgccatcaaggtcgatggcgattaattttatactcaagattattactcctaactaattatattgtttttgatatgagcttgaaaagcttcaaaagtatctgtaaacaaactctcgttactatctataagcatttccttggggaaaaagaagcgctcgtcacgagaaactttacctgaaattgctcgtactaaatcactaacggtcgaaagttcgactaggctaccatccgattgcattagttcaatttgagtccgtggttttttagaggttggatcataggcatcatatggtaagtcataactgtcattttcagcagtataatattcagaatcaaaaccagcttcagctaccaattgttttaattcaggtagaagactccgagtttgatcggtgatgcgtgctgattttaaaggaatacgatccaagaagcgataggcaagatcacttaaaataggatcttcatcatccacccattgaagaaaatacgtatttaagacgccgtcatctagttttaaataatcatctaacgtaaaattttcatcaaaaaacggcattaagtaatgaggttgaaagttacgttgtcgatggttagctcgctcagactgatatagctggttagctaactttaagagatgtccaagaatgacctccatagaacgggaaacagaatgaaaataaacttgaacgtacatttgaaaacgacttacaataaaatcctcgacggcatgaatgccattcatttgaaaggcgataccatgctcataaggacgcatcacacgtaagatgcgggttaaatcaaagtttccgtagttagttccggtgtagtatgaatcacgtaaaagataatccatacggtcggcatcaatttggctagaaattagctgtactacttgtggattaggataatcatggctaattacagaagcgacctttgttggaaagtcgggactaatacgtcgtaaaacttggttaacttcggtttgagggtccgtaataatccgggtagtaaatttttcatggtcggtattaaaaatatgttcaaatgtatgcgagtaagccccatgaccaatatcatgtaagagggcggcgcaaagcgttactaaccgttcatcattattccacaatccatcactgggagtttttgaaggataatttcgagcaaagctttcaacgatgcgacgtgctacttcataacatcctaatgaatgtgaaaagcgggtgtgttcagctccatgaaacacaaaggaagtggttcccaattgatgaattcgacgaagacgctgaaattctttagtattaatcaagtctaaaatgacttggtcttgaacataaacatagtcatggataggatcacgaaagactttctccatcggtaaacgttgattttcttgggacatcttactaccttcttactttgtaattttaaaaagaaacatctacctaaaattatacaagttttaaggtgagattgtaaaagcttaaagctagaataatatatgaaatgaattataattattacattagaacagtgaacaaagaggaggattcaaatggctggattaaacaatggcattccaattgaaatccatttagagacatttattgaacaagaaggtgaaaaaacacacctagctttcgacgaacccggacagatttttcaaatgggcgattcactttacttaaggtatcaggaaaaaaatgaagaaactggaaaaaaatcacccgtaaccatgaaaatcgatggggatggcaatgtcctattaacacgttcgtctgagagtgaaatgcgtttgcgttttgctaacggtaaaagaattgaagcgcggtatcgcacgccttacggactttttccgattgaaacagtaacaccatttctagagatagaactccaagaaggaccccttgcgggaagggtaaacattgattaccaactttttgcaggagaacagttgattggtaactacaaaatccgattgcaatttactgcttaattgtagtattatttgagatagactgtggaaaggacgtgcaccagttggaattagaaaattttaagggtcaaaacaaaaacgaactctcaatgatcgaagttgcccacgctattttagctaagagtggtgaaccaatggcttttgttgatttagccaacgcggttcagagttatttagataagacagatgaggaatttagaaatcgattatcacaattttatactgatttaaacgttgacggaagttttatttccttgggcgaaaatacatggggacttcgtacttggtacccattcgaatcaattgatgaagccttaattcacgctgaagatgaagacgaagaccgtcctgtacgtaaaaaacgtaagaaggttaatgcctttcttgctgatgcagctgatgacgatgatgtaattgactacgattctgatgatccagaagatgaagaagtcgaagctgaagatactacatcagatgacgctccagcatttgaagatctttctaacgatgacgatactgatgttcttccagatggaattgaaggtcaactatcagaattaaacgaagatgacgaaaactaaatatacaaacttgacttatagtctgtaactctgtattatattttttgggctctggagatccttttgaggatttttcagacaatgaacggtaataccccctattctcagaatagggggtatttttattgttgtatcagtatttcaacagtaaaaacaactgttttgcgtttcctaatttaaccagtcataaatgttagaaaaggagaattttaatgaccaaatatatttttgttacaggtggggttgtttcatctttaggtaaggggattgttgctgcatcccttggacgtcttttgaagaatcgtggacttaaggttacgattcaaaaatttgatccatatattaacgtggatccaggaacgatgagtccttaccaacatggtgaagtttttgttactgatgatggaacagaaacagatttagatttaggccactatgaacgttttatcgatattaacttaaacaagtattctaacgttacaactggaaagatttattcagaagtattacgtaaggaacgtcatggcgattatcttggtgcaactgtccaagttattcctcatattacggacgcaattaaagaaaaaattatgcgcgctggtaaagtgactgattctgatatcgtaatcactgaaattggtggaacggttggggacatcgagtcacttcccttcttggaagctatccgtcagatgaagagtcaagccggatcagaaaatgttttctacatccacacgactttggttccatacctaaaagctgcaggggaaatgaagacaaagccaacgcaacacagtgttaaagaacttcgtggtttgggaattcaacctaatatgttggttgttcgtacagaagaagatatcacagatggtatgcgttcgaagattgctgcattctgtgatgttgagccagaagctgtaattgaatctcaagatgttgcaagtttatacgaaattccattgaacttaaaagcacaaaagatggacgacattgtgatggaccactttggtttgcaagcaccacaagcagacatatctaagtgggaagatcttgtcgatcacgttaataaccgtttgaaccataccattaacattgcattggttggtaaatacgttgccttacaagatgcttatatctcggtgaatgaagcgttaaaacatgcaggttatgttgtcgatgcagacattaagattaccaaaattgattcagaaaaacttactaaggaaaatgttgctgaacaacttgccggacaagatggaatcattgttcctggtggctttggtgatcgtgggattgaaggaatgattcattccattcaatatgctcgtgaaaatgatgtgccattcttaggaatttgtttaggaatgcaaatggccagtgttgaatttgctcgtaacgtattgggttaccaagatgctaattcggctgaaatggatccagcaactaagcacaacattattgatttaatggctgatcaagaaggtgttaaagatatgggtggtactcaacgcctcggtctttacccatgcaagcttaaagaaggatctgtagctgccgccgcttatgacaaccaagaaatgattgaagaacgtcatcgtcatcgttttgaatttaacaatgactatcgtgctgaaatggaagctaagggtcttgtattctcaggaacttcaccagacaatcgtttagtagaagtagttgagttaccagaaaagaaattcttcgtggcagctcaatatcatccagaatttttatcacgtccacaacgtccagaaggattatttaaggcatttatcgctgctgcaaataaataaacataaaaatagtcgaatttttcggctatttttttatttgttgcgttcatgaggttgtatttttggaacaaattatttatgattgaggttgactgtaaaatacattccttaattttaaagtacttaaagttcgtttgtgaggaaaaaccatgaaaaaaatgataatcaagggtggacagcgactgtctggagaagtgaccatcggtggtgctaaaaatagtaccgttgcgttgattccggctgcaattttggcggatactccagtacggtttgattcagtgcccgacatacttgacgtgcataacttaatgattatccttgaatcgatgaatgttcattcaacgtttgaggatggagttatggtgattgatccaactgaaattgttgagaatccattgcctagtaaggcaattaagagcttacgagcatcatattactttatgggctctttacttggtcgtttcaagcgttcaacagttacatttccaggtggagataatattggtccaagaccaattgatcagcatattaaaggcttcaaagccttaggtgccaacgttacagaagatgaagatacagtgtacatttcagcatatgatcgtggactccatggagcgcacatctttttagatgtggtttctgtaggagcaacgatcaatgttattttggctgccgttaaggcccaaggtattacaacgattgaaaacgcagcacgtgaacccgagattattgatttagcaatgtttttaaataatatgggggctaaaattcgtggagcagggactgatgttatccggattgaaggtgtggataagttggtttctacagctacgcataccattattccggatcgaattgaggctggaacctatctgtctttagccacggctgtgggggatggtgtgatggtaaataatattattccagaacacctagaatcgtttacttcaaagatgcttgaacttggcgtcgatattaaaattgatggcgataagatttttgttcctaaagtggatcaattaaaagcaattgaagtcaatacgagtcctttccctggatttgcgactgatttgcaacaacctttgacggcttccctattaaaagcaactggtcaaagtgttgttaatgatcatatttatccagaacgtatcaaacacgtaattgaattacaaaaaatgggtgctaagattaaacatgctgatggagtgatttatattaatcattctgaaaaacttacgggcgctgaagttgaggctggagaaattcgggcaggggcttgtttaatgattgcagcctttatggcccaaggcactacaaccatcacccgagcagataacatcctacgtggatacgacagtttggttaaaaaactaactaagctcggagcagatgtttcaatcacgaccgacaatacattgtagtcaaagatataggagagttaagtcgatggataattttttaacaatgaatgacttgcaagaaatgactctcaaagaaatatacggccttgcccgtgaatataagatttcatattacagccagatgaacaagaaggaattgtctctggctgttttgcgtgctcaggctaaaaagaagtcatttgttgaaatggaaggcgttttagatatcgttggaaatgatggatatggttttttacggccaatcaactatggttcttcgcaagaagatatctatatttcagcatcgcaaatcacacgtttcggtttgcgtaatggggatttagttggtggtgaagctcgccatcccaaaccaggtgaacggtattatggattaatgcgggttacttcagtgaataataaggacccagaagaagctaagcaacgtcctcattttccagctctaacccccatctaccccaatcaacaattaaaattagaaacaacttctaatattttatcaacgcgattagttgatttgttttcaccaattggatttggacaacgtggtctggtagtagcaccacctaaagcaggaaaaaccactttactaaaggctattgctaacggaattaccacaaactatccagatgtgaagctcattgttttactaatcgacgaacgaccagaagaagtaacagatttagaacgctcgattaagggagaagtggtttattccacctttgatcaagaacctcggaatcatactcgtgtttcagaattagtattacaacgggcgcttcgtctagtagaagataaacaagatgttgttgtcttgctagattcaattacgcgattaacccgtgcgtataatttagtgacctcccctagtggtcgaactctttctggtggggttgatccggcagcgttttataagcctaaaaaattctttggctctgctcgaaatattgaagagggtggatcacttaccatcattgggacagctttggttgatacaggaagccggatggatgatgtgatttatgaagaattcaaaggtacgggtaattcagagctagtcttatcacggaatttagctgagcgcagagtatttccagcgttagatatccgccagtcaggaacacgtaaagaggaactaatggtctcaaaagatatacttaatcagctttgggatattcgccggtcgatgcgtggagatgctctggagtatacggaacaagtgcttaagttattgaaaaacactaaaaacaacgaagcgtttattgctaacttaaagaatttaaatttaggtcctaatggtagtaaaaaatcttaatcgaccttgtttaagttgtttttctatgctattattggggacgttgatttataataaataactatgactcagcaaatgactcatggcaaaggagcgtaatatcgtgaaaaaaggaattcatccagactatcatccagttgtatttcaagattcagcaactggctttaagttcttgtcaggttcaactgtaggttcagctgaaacaatcaagtgggaagacggtaacgaatacccattgattcgtgtggaaatcacatctgactcacatcctttctacacaggacgtcaaaagttccaacaagcagacggtactgttgcaaaattcaacaaaaagtacggtttggcttaatcataaccattggttatcaaaaagaggcaccgctgaatttatcagtggtacctctttttttgtggtctgaaatatagtttaggattgcttctcattaatcgacataacacagcgttactaacttgatttatgctactgatcgtccgtttaaccaacggaataagataaagttaattaaaactaatacagaagtagcaataaagacagcgttatagtcaaataaaccagagactgcagagcctagtaatgggccaatcatatttccgagtgcttggaaagactggttccaactaaatacacgcccagttaccgcagcaggtgttcgtttagataaaatactctgaaccgctggtagcatcgctccatcagaaattccgataaagaagcggaaaactcctagccaaaaaatagaaggaacaaaggccattggaatgtagaataccatggcgaagagaaaggccacggaaagaactttttcggttccaatctggtccccaagttctcctaagcgcggagccgctaacatgttagcgattcccggaattgcagcaattaaaccagcaaccattgttacaccagccccattatgcattaattctttaacgtataaactaataatcggcgcgattgaattattagatgcttgaataatcatcgttgtgataaacatgccgaatacggccttaggctgatttagtttaccaattacctctcgagcagaaagcgaaccagattcactttctacgggaacgaagtgttcatgtaccaagaagaaacttaggaaaaagacgattagtaataaaccacctgtaataaagaaagttactcgatatgaaaaaatagaagctagtgcaccaccaatgaggggacctagtagagatccggatacaggaccagtagataaaataccaagtgcataaccacttttttctttaggagtttcggtagcgatgagtgcattggagttactaatataacctgcaaaaacaccttgtaataaacgaaggccaatcagttgaaagacgttttgaacaaggcccattgcgcctaagacgaaagccattccgagtgaagctcttaaaatcattacttttcttccacgcttatccgcaatttttccccaaattggagaaataattgctaaaattaagaaagtagaagaataagttagaccactataaaaagatagttgcgattttgagaagtcaccgagtgtgttgacataaagcgacaaaaacggcataatctcactaaatgcgaccccggctatgaaggttccgaaccaaagcacaaaaagattttgttcccaaggttcacgtttctttctagattgtccttttcgattgaaaaacatcataaaaagccctctttcaaaaaagatataccaatatacaataccataaaaattaaaaatagtaatggagcaaacgtcaatgagtaaaaaactaaaaaattggttagtttcgattggattaacattattggtgctactaagtttagcgatgatttttaatcgtcaaatcaaaacatggatggtagcacaatataatccagaggtgaacgagaaagtggttgctaaaaacactgaaaagaaagccaattttgactatacaaaagtaaaatcattggattggcagacggtcctaaaggcacggacttcggagaaaagaattaaagtgattggtgaaattgtttaccctgatataaacatacaccttccgatcggcaaaggggtcgataatcttacgttggcgttggcggcgggaactttaaaagaaaatcagcgaatgggtgaaggtaactacgcattggctggacatcatatggttgataaaaatgttttatttagtccgctttattggaaagccaaaattgggcaaaaggtttatttgacagatgagaccagtatttatgagtatcgggtagacacccgtaaatttataaaggcgaccgatgtgcaagtagttgacgatattaaaggtaagaaaattttaacgctggttacctgtgatgatacgggagcgggtcgtttgatgattcgggctaaatttatcaagaaaatgagtcataccaaggctccggaagcagttcaaaaagagttttcagaaaagtttaatcgttaagaaaatttagtgttcaaattcatataatttgcttgacgaatttgttactattaatatcatatataggaagttttgaaaggatgggattgaatggtaggaatgataatagcactaattgtaattgtggtgattgtaattgcgatcgtctcaatgtacaacggcttggtaaaagctagaacctatacacaggaatcatggagccaaattagcgttcaaatgaagcgtcgaaatgatttgattcctaatcttgtaaatacggttaagggatatgcagcccatgaaaaagatactttgagtaaagtggtggcacttcgtaatcaattagtggatcagactgataattcagccccttctactaaacaacgtgaagagattatgaaaacttctaaccagattagtgactcacttaaaagcatttttgctttatctgaaagttatcctgacttgaaggctaaccaagaatttactaaattaatggaagaattaactaatacagaaaataaaattgcttattctcgtcaactatataattcgagtgtagcaagttacaacattaaactacaatctttccctaataatttaattgctgggatgggtggatttaagccggttgattatcttcaagttcctgaagaagaaactaaaaacccaaccgtttcatttgataaataattaagaggtcgattaatgttatatcaacagattgcaagtaataagcgaaagaccgtttatgtgatgatcggttttgctatcttagtattgtttattggtgctgcagttggttatgttttctatgatagtgcaatggcagggattattatggcggcagtaattgccgctatttatatggccatgatgattgccaattctactaacgtcgtgatgggaatgaatcacgcaactgaaattagtgaagccgatcatccggaaatttggcatattgtagaagacatggccttggtagctaatataccaatgcccaaggtttatattgttaacgatgccagccctaatgcatttgcaacaggaaatagccctaaaaatgctgccgtagcagtgactactggtattttagaacggcttaatcgagaagaacttgaaggtgtaattggacacgaagtttcacacattcgaaattatgatattcgcctttcgaccatcgccttggcattatcttcggcgatcgcaatgctagtaaatattggaatgcgctcattttggtggggcgggggacgacgtcgcaatgataatgacaatgaaggcggaagtttggaaattgtgatgatgattatttccatcgtattggtcattttaggtccaattgccacaactatcgctcaattggctttgtcacgaaatcgagaatatctcgccgatgcctctagcgttgaattaacacgtaacccactggggctaatccatgctctacaaaagatatcggtcagtgaaccgatgaaagaagccgatccaagtagtgctgcactttatatctctgatccatttaaaaagaaacgtaccatggcacatctatttgatacgcatccaccaattgaagatcgcattcaacgtttggaaagaatgtaagtatatagttaattgaaagagagttatgggatcatgcgtgatgactatatttttgtacatttagaatcaattgttaatttaatttattcgcgcgggattacggcaaatgattttctaaagggagtcttgcaaataccaaccaatgttttattattaaatcgggaagtcagtgatgatttaacgattgataatcatacatttttaaatgaaattaatggcgctaaaaaagttagtgagtatttaattggaaaccatggcccacgcaattggattgatttttctcagcgagatgcgttgagtgagctcacgccggctgatattgctaatcttttatatatggggcatatgaaaactcataatgatacgccattttcgtataagctccaaaacgactatgtttatttagacattggcgaaaatcaggtgaagacctattatcgtcgtctaaaaaatttttatttagttttgaatcaatctattattcgtcatgctgaacaagcttataacgagcatcgaattgtatttcgtcggggaaataaatttgctgaattaccagctggaatggttcgacaattaattcctgtgttaggagaaggattaatttttgcgtttgatcaagcttttgagcaagatcgcgaatatcgaatcccgattttgattgctagcgacagtaatttggctcctacgttacgcagcaaagattcactttataataatgcccaacaaattgcgattttgaaatataatctacgtagtaaacattggcattttattattactaacccgcaagcctttgatgcggatgcattatattaaattgagaacttgtgtcagataagatataagttctcttttttagcaaaaaagggtaattattttggggataagatgtttagtctacttttaaggtaagttaatttaatgagctattatggtataattgtagccaggttttttaatttaaggggagttttaaaaagatgaaaatgcaacttagcgaaattgcgcgcgctcttggaacggatgaatatcctgaactatggaacgatattagcgtaacgagtgttcaatttgatagtcgaaaattatctccaggatcactttttgtgccaattatgggtgaacgtgacggacatgattttattagtcaagcagtaacagcaggcgccgttgcaactttatgggcggaagaccaccaagaacggcgtccagctgatttaccaagtattctagtaaaaaatccattagaagctctgcaaaaacttgctaaatattatctggataagattaaccctaaggtagttgctattactggaagtaatggaaagacaactactaaggatatgactgcagcagttctggaagcagaatataatgtggtaaaaactaaagcaaactttaacaacgaactgggcgtgccaattactattttgggaatgagctctaatacggaagtattggtagttgaaatgggaatggatcgtccaggacagttacactttttaagtgaattggttcaacctgatattgctgtgattacgatgattggcgaagcccatattgaattttttaagacgcgtgagcggattgctgatgcaaaaatggaaattacagatggcctaaaagaggacggttgttttgtttttaacggggatgaaccgctattagaacagcgtgctaaagacctcaatgttgaacaataccgttttgggtttaaagcagataatgatgtcagcgccagcgatatccagagaactgacacaagtacaatgttcaaaactaatttggatgaagaaaccaccgtaacaattccagtattgggtgattacaatgtaactaatgcattagcagcaatcgccgttggacataagtaccatattgacctaaaaaaagaagctgaagcgctagttgactttgatttaaccaaaaatcgaacagagtggttaactggaaaaaaaggcgaacgtattttaagtgatgtttataattctaatccgactgctgctcgagcagtattggattcatttgctaacgtaaatactgaaggacgtcgtttggtagttctaggagatatgttggaattaggtgagaatgctgatcaaatgcatgctagcttagctgaaaaattaaatgccaagcgttttgcgcaagtatatttaatcggcccacatatgaaagctcttgaaaaacgactgattgatgaagatatctacagtaaagatgctgttcattattatgaaactggcgaattaaagcgacttacagatgatctttcaactgaaattcaagcagatgatagtattttattaaaagcaagtcacggaattcatttagaaaatgttgttgataaaattaaaaattaaaaaataaagttgtgatgtggcttttagattttttacagcgtatgtaaattattcttaaaacgcggttgccgacctttgagtggggaatgctagcctaaatatcacaactttatttttattaaaaaggccaaatagagctgttttaacagcgttttcaagaacttttgtttgctaatccctaagcaggggtgtatgattataaagttatgtttacacgattgtcaccgtgggcgcggccctaaaaggacggattttctttgatgcggtgacgaaaatttaggaggaattatatttgaaatttaccgaactagggttagacgaagacattttaaaagcagttttagacaatgggtatgacgaaccaacacctatccaagctgaaactattcctggtgttttagaaggaaaagacatcattggacaagctcaaacaggtactggtaagacagctgctttcggattaccaatcctacaaaatgttgacctagataatcctaacattcaagcaattattatctcacctacacgtgagttagctgctcaaacacaagcagaaatctttaaattaggaaaatataaaaaagctaaagttcaagtggtttacggtggatcagatatccgtcgtcaaattaatgctttaaagagccatccacaaatcgtggttggtacacctggtcgtttattggaccatattggtcgaaagacaattcgtttagaccacgttaaaacattagttcttgatgaggctgacgatatgctagatatgggattcttacctgatatcgaacacattattgaacaaacacctagcgaacgccaaacattattgttctcagccacgatgccagcaccaattaagaaaattggtgttaagttcatgactgatccaaaacaaattacagttaagtctaaagaacttactgctgatttggttgatcaatactacgttcgttctaaagaattcgaaaaatttgatattttaacccgcgtacttgatgtacaagcaccaaaacttgcagttatttttggtcgtactaagcgtcgcgttgatgaagtttctaagggattagttactcgtggttacaatgctgctggaatccatggtgatttaactcaacaacgccggatgagtattttacgtcaattccgtgaaggacaattagatattttagttgctactgacgttgcagcacgtgggcttgatatctctggtgtaactcacgtttacaactatgatattcctcaagacccagaaagttatgttcaccgtattggtcgtacaggccgggccggtgctacaggtacttcagtaaccttcgttactaactgggaaatggactatcttcgtgacgttgaacatttgacaaagaaacgtttgttaccaatgaagccaccaacagaagaagaagcttttgctggacgtgctgcaatggctgaacaaagcattgaagaattggttcaaaaaacagatgttgctaagttcgaagaacaagttgatcatcttttagaacaacatgatgctaaaacgctggttgctgcacttctaaatgaagtaactaagtctgacgctagtgaaatcaaagttaagattactcctgaacgcccacttcctcgtaaaaaaggtggcaacaaaggcggtaaaggtggcggcggataccgtggcggaaatcgtcgtggtggtaatggtcgtcgtagtaatggtaatagtagcaatggcggaggccgtggtggtaaatggaataacgatcgtaagggtggcggcaagtcacgctttggtcgcgatgaccgtaaccacaatggtggtaagcgtaatgatcgcaactcaggtaacaagggtggatcaaaccgtcaatttgtaattaaagaaaaataaacattttcaataaactaagaggcccggaaaatacattttttcttgacctctttttttgatacaataggaacgacattggaggtactaggatgatttacggaattggcattgatataacaaacattgatcgatttaaaacactccacaatccagcaacgtttatccaaaaggttttgacgcccactgaatttgatgagtttgaagctaagaaaggtcaacgcgcgtatgaatttttagcagggcacttttcggttaaagaatcatatagtaaagcttacgggacaggattaggtaaaaaacttaattttcaagacatcgaaattaattacgatggggttggaaaacctaagattgttaaacatccgtttagtggaaccgtacatgtgtcaatttcccattctgaccaccatgttgtaacacaggtaattttagagggggataattgaaatggttgtagggatacatcgtcccagcaagctagttattaatgctgaggcaattagaaataatgtaaaaaatgagattagtcgattagatggacacagtgaattatttgccgtggttaaggctaatggctatggacatggaattgtagaaacagcccaatttacgaaacaagctggggcaactggtttttgtgttgctatcttagacgaagcgttggctttgcgagatgctgggctaacagaaactatcctagttttaggaattacagatgttaaatatgctaaattagctgctgaaaatgatatctcgttaacggtgggtgatcaagcatggctagatgaagctacgcaaattctagatcaaaagccgctgaaagttcatttaggtattgatacaggaatgggacggattggttttcaagatggagcttcttttaagaaagcggccgattatcttgaacaaagtcaacagttcaattttgaaggtgtgtttacacattttgcaacagcagatgaaaaggatacgacttatttcaatttacaggtggaacgttttaaccatttcatcagccaattatctcgacgtccacgttatgtgcatgtttctaatactgctaccagcttgtggcatgcagcttgtaatggtaatatgattcgttttggagtcggcatttatgggatgaatccttctggaaaaacactggaaagtccttttgatttacagccagctatgagtctggagtctgaactatctttttctaaactagtgcaaaaaggccgttcaattagttatggagcgacttatacagctaaagaagatgaatggattgggacgatcccgattggttatgcagatggttatgaacgtcgtttacaaggattccatgttttgattgatggtcaattttgcgaaatagtaggacgaatttgtatggatcaaatgatggttcgcttaccaaagtcatatcctgtgggaactaaagtaattttagcgggaaaatcaggcgaaaaatcaattaccatgacagacattgccgaatatgctgggaccattaattatgaaatcacatgtggattcacacaacgtttaccacgaatctatactgaaaatggtgtagtaaattaatgtattgaatgctaaaataatgttaataattaaatagtacaggagagcaatctaatgagtattcaaccaaaagatatgtcaattgagaaagagacttactgtgaaatgtttggttttgaacctagttgtgtaaatgatgatattgtaaggagcttttttacccgtcacgcaactgagcatcttgaacagcttaaagccggatacctccaaatggctgatatcaattccgaaattactcatgacttttcttcatgtgaagcggattgtgaaaagcatgtgcttgaacgttactaagttaaattttttaaattaaaagttaatggggtgacactgtggacgagtcgaagataagacgcggtgatttattctatgcagacttgtcaccagttgttggttctgaacagggcgggatgcgaccggttcttgttatccagaataacatcggtaatcactatagtccgacggtcattattgcagcaataacggctaaaatttctaagcctaagatgcctacccatgtaggaattaaaggtggagaacaaggagtaggccgtaattcagttattttaatggaacagattcgaacaattgataaacaacgtctacatgataaaattggtcgattagatgaccagaagatgaaacaggtggacgaggccttaaaggtaagtataggtctcgtaccgaatacatagaatagaaaatgtgaacaaagtttcacgctcaaattttaaaaccacctattccaagatagaaaaaaggattcgcaaactgtgaatccttttttatttacgaactataaacgatcttgttttaggttttcaacttcaggaactctgaagcctttacgttctaagttgctaataatttgatgtaatctcttttcatcaacacttgctgggagagtgaacatcatccgatgcactaaatccccctcttcaacgtctaaagagataacactagcaattgaggtatatttagtaatgatctttgcaatcgtctctaaatcgcctcgttcgtccccagaaatgacagtaatcacataactaccaacatttacgctccacgattgagataacccatccaagagacgtgcatgggttaaaattccatagaagtaattgttatcatctaatacagtaatgaaaggtaaatccttaattgagaagaagacgttaaagaaagcagcattaacattaatatacttagtggcattttttaaaagagaagtcacaggttcttgcattgatccaccgcgtgatttgtggcgataaatatgcattttgtaaatatttccacggaacaagcgacccgttttatctaaaactggaacgcaacggaatccagattcttcaagaatatcaagcgcttcttcaagagttgcatcttcacgaacagttgttaaatctttcttaggtttgaccattgattttaaaagcattagaatttcctcccaaaaccgcaattttctttaatacaaatttaataataacacaaaatgataatttagaacacgactaccggtgttccgagggctacttcagcataaacagttttcatcgttgcaggtggagtgttgacacaaccatgggaaccatgggttttataccaatctccaccaaatttaggttgccatgaagcatcatggagaccaactccagtataatcaattggcatccagtagctgactggtgaggcataattagagccatccgtatttttaccttttagggtagcattacgttttttattccaaacaaagaacacaccagttggagtgtcatcattatttgcaggcattccagtaacaacatcagttgaaattttaagcttgccgtctttgtaataccacatatgttggttagttttatcaacttcgacatacgttgatccgagttcaccttttttaagagattgtccagaacctgaaattgtagctttttcggtgaagtctttaccagttgcaattttttgggctatatcagctgcgtcggtggtagtatcaatggtccaaccaaaaatttcatttttaacagtttgagaaccacgtttagtactattaaaggtcacactagctccataggtagaatacttatcgtttaagtcatctagataggctttaacttgggcattatcaaccgaaacagtttgagtaccgtcgtttttagaagtaagaactatccactgctttaaagtatcacttggaatagtgacattggtaccgttgatgttataagtaattttttctgctgtatactttttaatttgtttttgaatatcatctgaattaacagtagctgattgatatgttttggttaaatcaatatctttttgtccttttgcgatgctggttttgatttcctctgcaagcgcagtagaactaattatcttattaccttttttagagcttgagctagccagttcagtggcactaatagcggaagctgaaccagtattacgattcttattcaaagtaatcgctgtttttttagcaaattcttctaatttagccttgctagttgcgtttactgtgttatcagcattagcggcatggacaagttgtaggggccacattaaagcattttgtttattgagaagcttagctatagtcttattatcagaagaggttaaacctgcatctgcatatttagcagttttgagaactttgtttttttcagttaaattaaaagtttggtttttaacatgattgttaaccagtgtttgtgcctgatttacatttttcccagcaacatttacgccatcaattacagtattaggcatgaatgtgttggaagtactgtagtggattgctcctcctgcataaattaagactagcacagcagcgactgcaccaagtattatgtaaggaagtttccttgtttttttaagatgatttgatctacgttgcatcgtgagcctccgaaataaattttatcctctgtaacattactgtaataaagaatattaatcaagcctatttatatatttttatttagtaaatagaaaaatacaggtcaacatggagtggttgatttttaatgacgagagaatatatagaaaaattaaataactaaaacattaaaagtgtttgctatcttcaaaatatttaatcagttattattatctagtaattaattgcatacggtaaatattacttacctattatatcagaagaaatgctatctttttatgaagaagtaatgttagaagcgtgaaattagtaaattgggcataaaaaaacgactctgaatatttattcagagtcgttttttcaactatttgaaattagttgatgttgaaaagcttatttttcttcaagagctttcaaaccatctgtaagaacttttttcaatgttgtagctgaatctgtcatcttcttcatttcgtcatcactaagtggtgattcgataacacggttcaaaccttggccgttaataacagcaggtgtaccgatgtagatgtcattcaaaccatattcgccgtccatgtaagcaccaacaggcaatacagcattttcgtcacgcaagatagcttttgaaatacgcatcaaagcagtaccaacaccgtagaatgtagcacccttcttgttgatgatttcgtaagctttgttacgaacactgtcttcgatttcagctaattcgtcagttgaaacgccttcttctttagcgatatcaagcaatggctttgtaccgattgaagcagttgagtaagcagcgaattcactgtcaccatgttcacccatgatgtatgcatcaactgagtcagggctaacgttgaatttcttaccaagagcaacacgtagacgtgctgaatcaagagaaatacctgaaccgataaccttttctttagggaatcctgagaatttccatgttgcgtaagtaaggatatcaactgggttagcagcaactaagaagataccgtcgaagcctgagtcaacaactggcttaacgattgttgaaagaatgtttaagttcttgttaacaaggtcaagacgtgtttcacctggtttttgtggagcaccagcagtgataactacaagatctgcatctttacagtcagaatattcacctgagtaaatgttcttaggtgcagtaaatggagtagcatcttcaagatcaagtgcgtcaccaacagtacggtccttaacaacatcaacgattacgaattcttctgcaattccttgttgtgccattgcaaaggcataacttgaacctacagcgccgtcgccgactaatacaactttttgatggttttgaattttagacaaaagatcaatccccttttttcatataatatttgaatttatcaaacaatactaagtatagcattttcataaaagaaagttgagtaaaaattttatgaagttcgggtatagttagtaaagtgattgataagttagaggttaaaagacccgcttggggtcaataatatggtaatattacatgaaaataaacgtggacagctgaggggttcttgctctttcagccgtttttgcgtgttgagggtggaaaaataacatgaaaatgattgtgggtttaggaaatattggtaaagaatatgataaaacgcgccataatactggttttatggttgtcgatgaattagcaaaaaagcatgatataaataattttaaagttcaaagtgatgccttgatcgcagattttcgagtaaatggtgaaaaagttttgttagtaaaaccaactacttatatgaacgattctggtcgagcagtgcgtcctttaatggattactacgatgttgatttaaatgacatgattgtggcctacgatgacatggatatgccggttggtaaaattcgacttcgtcaaaagggctcagccgggggacataatgggattaaaagcataatagcccatgtaggaacccaatcctttaatcgagtgagagtagggattgatcatccgactaaagaaagcgtcgtggattacgtactaggtaagtttaggaaggaacagataaccgattttgaaattggtgttcaaaatgcagtagcagcattagaagattggactacaattgaaaatttcagtcagctaatgaataaatacaactaggattatttaggagcaagtatgaatataaatgaaatttttgcatctgattcgggagttacaaccgttgttgatgctctccaaaaagggtcgcggcaattagttactggtttactagagccggctaagcaactttttttaagtacgattattgaaactaaatcagccccaattttatatgtaacagatagcttagcgcgggccgaacatgtctataacttgtttaaagaagaacagtccgagattgatacgtactggtttccagctgaagagattattgcggccgaggtggccactagttcgccaaattatcgtacggcacgaatccaatttttaagtgctttagcgacatcaaagacaggtatttttattacttccacatctggattacgccgattagttcccgaacctaaggatgttattgaagctcgaatcactctggaagtgggggttgaatatgagttccaaactttaattagcgatctgaatgcgctgggataccaacgggttgaacaggtggaaaagaaaggcgaatttgcggttcgaggttcggtagttgatatttttccacttaatcaagatgacccaatccgaatggatttttttgatatcgaaatcgattcgctgcgaacttttgatcaagcaacccagcgaagtattgaaaatatcgaaaaaattgaagtattgcccgctacagacttgataataaatgaaacaaaattaaaccaagcaattaaaacgatgaataacgagctggcgcaagctcaaaaaaaattaagcgaagaaaactttgaggctttacaacaaaatattaatgaagtaatcgagcgctggaaacaccaccaactgattcaagaagatacaatgtacgctaaacaattgtatgcagctaaaacttcattgctagattatctaacaaagggcacgctagttttagacgactatccccggatcttggatgctgaaactgacattgaaaataatgaagccagttggatcgttgatcagttaaaaaataacgtgttgttagataacgaatcctttggcgtcgatattcgaacattgatcaagaaaaagtctgttcctcagttatttttgtcgatgttccaaaaagggatggggcgcttaaagtttgaccagttgacggaaatcactactagggctgtccaagatttctttggacaaatgcctgttttaaaaggtgaggtggaacgatggttagctcgtaagcaaacggtgttaatctttgccaattccaaagaacgacaaggaaaaattaccgaagtgcttcacgattttgagattgctgctcaaaaagttaatgctgatagaattcaaatggcagcggttaacattattggacaatcatttccacaaggctttgatatgcctagtacgaaattggtagtgttaacggagaaagagctatttgctaaggttcctaaaaaacgtcctcgccaacaacatgtggaaaatgccgaacgtctcaaaagctatacagaactaaaaactggggactacgttgttcatgtcaatcacgggattggaaagtttatgggaatgaccacgatggaagtcgatggcgttcatcaagattatatgaccatccagtacaaagggagtggtcaattatttattccggtaacacagttaaatcttgtacaaaaatacgttgcagcggaaggtaaaagccctaaattaaataaactgggtggctctgactgggctaagacgaagaagaacgttgcttctaagattgaagacattgccgatgacttaattgaactgtatgccaaaagggaagctgaaaaagggtttgcttttaaaccagatgacagctatcaacgtcaatttgataatgattttccatatactgaaactccagatcaattacggtccattgaagaaatcaagaaagatatggaaagagaacgcccgatggatcgtttgctagtaggagatgttggctacggtaaaacagaagttgcgttacgggccgcctttaaagcggttgaaagtggtaaacaagtggctattttagttcccaccactattctggcgcaacagcattttgatacgatgaatgaacggtttgaaggatacccaattgcaacgggaatattgtctcgtttccaaactggggcacaagttaaggaaacccttgagggattaaaagatggcagtgtagacgtgattgttggaacccatcgactattatctaaggatgttgaatttaaagatttaggattactggtaattgatgaggaacaacgttttggggttaaacataaggaacgaattaaagagcttaaatcacaggtggatgttttaaccttgaccgcgacccccattcctcggacattgaacatgtccatgattggggtgcgagatttgtcagtgattgaaacaccgccaactaatcgttatccgattcaaacgtatgtaatggaagaaaacgcgggggctattcgtgaaggaattatgcgagaaatgcgccgtaatggacaggttttctaccttcataatcgagttcaagatattgaaaaagtagtggctgaaattgaagcattagttccagaagcccgagtgggttatattcatggacaaatgaccgagaaacaattagaagatatcttgtttgaatttattgcgggtgagtacgatgtgttagttacaacgacaatcattgaaaccggaattgatattccgaatgctaacactctttttgtggaaaatgccgatcatatgggactttcccaattatatcaacttcgtggtcgaattgggcgttcatcacgggtggcttacgcgtatttcttgtatcagaaaaaccgagtgttaactgaattaggcgaaaaacgattggaagccatcaaagatttcacagaactaggttctggatttaaaattgctatgcgagatttatcaattcgaggcgcgggaaatctgttaggaaaacaacaacatggctttatcgattctgttggatatgatttatactcacaaatgctggcagatgcggttaagaagaagcaaggtaaaaaggttaaacggcgttcagatagtgagattagtctcggaatcgaaggttttcttcctagttcttatattgaagatgaacagcagaaaatcgaattctataaacgattacgtcaggctaacagtcatgaagaagttgttgatattcaagatgatatgttagaccgctttggagattatccagctgaagttgataatttattacaaattaccgacttgaaaattatagccgatcaagttcaagtcgaaagaatcacccgcaaggacggtattttaactgtaactatgacaagggcagccagccaaaaattaactggtgagcagatatttgaagcattatcagttacaagactaagagcgacggtagcggaatcagatgctaaaatgcatattaagctggtaattcaaccacgaatgacacaaaaggattggtttacacagctgtttaattatattgagaaacttaaagaatatgtgtgaggactgattgtgaaaaattcgagtgctaaaaaggttatgcgtggggcattaattttatccatcgcatcaattgtggctaaaattttaagtgcagtctatcgagtgccacttcaaaatttagttggtaatactggtttttatgtataccaacaaatctatccaatttatggcattggaatgacctttgcattaaatggatttccgatttttatatcaaaaattattgctgaggaacccgaagaagaaaaaaggttacgtttaagtcgatatgcgatgctaattttggcagggctatcattgttaatatttttatttttaatggtaggtgctaggtggattgctggtgcaatgggggatgttagtttaaccccactattgcgaatggtttcgactatgttcttgtttatgccattattggcgacggggcggggttactaccaaggaacttatgatgtggcgccgacggctaaatcacaagtgcttgaacaagtagtgcgggtttcaatcattattttagttgcggtattggcggttaaactaaattggtccgtgtataaaatggggacttgggcgatggctagttcaactttagctgccgttgcttcaacgctcttttttataaagtttgggtccaagttaataaaagctaaacgacataaatttaattggcaactgtttaaaattttagtgaaacgctttgtggttgaaggtggcgtaatttgcttattggcagccatgattattttgctacagttagtagattcgttcacggttaaaaatagtttggtcagtggtgggctaactcaatcaatggctaagtcgatgaaggggatttatgatcgtgcacagccgttagttcaattagggacggtgattgctacggcttttgccaccacgttgctaccatctcttacggaggctttacaaaaaagggacacaaaagccttttatcgatcagcaacctcactattgcgggtttcactaaccatatcgatggctgccagtataggaatggtggctttaatgcctcaaatcaataacctgctatttggcagttcggaaggttccttagctctagctgtgtacaatttaagtgtgatttttgctgcattaatctttgtgtataacagcatcttgcaaagtgcgggggctgttaaaccgaccttggtggccattatcacaggaattataattaaagttgttttaaatagttgggctactcaatggttgggaatcttaggagctagtctcgtgacagtattaagcttagctgtgattgcaggtgtgatgaattatgcattaccgagtcagttgtcgaaacgggtttaccgagaacatcactttttaaggaaactcatctggggaaatttgttaatgttcatagtagtaaaattactcgtgattgttttacaattaacagtagtttctccaggacgcttcggcgctactattatcacagtaatgggtgtaatcgttggagcaggtgtttttattagttatatctttaaattcaggttatttagtattcgggaatggttgactattccctatggttcaaaaattttaagaatggtacagaggattgttaaatgagattagataaatttttaaaggtttcaagaattatcaaacggcgtgctttagctaaggaagtagctgatcaaggacgaattttgatcaatgataaagtggctaaatcttcaactaatgtgggggtaaacgaccatattgaaattcgttttggaaataaaacgttggtaattaaagttgatcagcttttagatactacgaaaaaagatgatgcagaacggatgtacacgatcgtttccgaaaattacgaacaagattttagaaaataattaagaagttaaaaatgatagacagttaaagaaagcgttgttataatttaagataattgagaggttattttaatggaaaatgtgaagaaaaataagagaagtatgaaagcaagaacagcgacaggagcagtaaatccctatgctagggcccgtaaacaacgagcactatttattttaggtgttttcgcgattattgcgaccatttttatttttcaaattgtccatgcacatatttccagaagtagcgttaataataaattagcaatggaaacagcgcattatgagaagattcaaaatgataacaaggcgctcaaagtcaaagttaagcagatgaacgatgaacaatatttggaaaaattgattcgttctaaatatctctatactaaaaaaggtgaaactgtctataatttgccaaatgatgcaaaataaaattagattaaagcattgaaatgacgtaggtcatcttaatgctttttttgttaattaatggactgaatttgcgtgaacaaaactcgcaaggagtcggtgtggaatggtataattaagcattaaattttttaggaggatcataggtatttatgacaatcgaagttggaactaaggtagacggaaaagtttcaggaattacaaatttcggagcttttattgatttgggggagaatcgttcgggcttagtccatattagtgaagtttctgacggttttattaaggatattcatgacgtacttaatgttggagacaccgtgaaggttaaggttttatcgattgcggacgatggaaagattgctctttcaattagaaaggcagttgatcatcccgtacaaaaagaaactgctaaagttgcttcaacttcccaccactccaatggaaatttccatggccgtccagcaggaaacatggatagaaagtattcacataatcaacacagtcatcgcgataatcatcgtgaacaacgcagctcaaatgtggaaccagattttgatcaaatgctctctggatttttaaaggatagtgagtcacgcttatcaacgttaaaacgtaatacggatggtaaacgtggtggtcgtggcggacgccgtagttaactatgaaaatcggtgagctaggtgatcagattgttgaacaatatggactgagccaattcaaaatcgtagtggcagtttcaacgggagtcgattcaacggtgctaattaacgcattgataaattcaactaaaattaagcatcaacaattgattgttgcccatgtcaatcatcagctgcgtgagcaaagtattgaagaagaacgatttttacataaatggtgtcgacagcatcaaatcacgtttatggagacggactggcctaaaagtcagcaccctcaacatggagtagaagctgctgcacgcgaatttagatatactttttttaagcaggtaatgcatgaccagcaggcgcaagtactattgaccgcacataatgcggatgagcaagctgaaaatttcgtaatgcaagtgattcgggggggctggctaaatcaattaaatggaattccagaacggcgaacgtttgcacaaggatggctaattcgcccgtttctaaagctaaccaagcaatttttgattgagaccgctcaagaaaataaattacggtggtttgaagatcaaaccaaccgtactactgaatttttacgtaaccgtgtgcgaaatgaaatcattcctgcttttcgaaaagaaaatccaagggtggttgaacatatccagcactatcaagatcagctattagaacagtctaacttagtcgaccaagtggttcttgaaaaacttactaagttacaaagagatgaaagctttgatctgctggcgctacgtaaagaatcgctcccatggcagaaaaaaattattttaaaaattattactgaagttaatgcggaaattgcaataaatgagaataagttggatgagctagttcgattggttaataatactaaacaagctcaagctacaatcgacattggaaaaaactataaatttgaaatcacgtacaattatctacgaattggtaaaaaaataaccgtaaaaggtgaacaagtaaaaaagcgtgtggtaacattgaattcgtggttaaatttagatggtgatgctcaattccaattatctaatcaaaagtcggctttggatgctgacgagacgatggttttgagcgccaatcagctgaggttcccgctttttatccggaaaataaaccccaacgaccgcttaagacttaaaaatggtggttataaaacaattcgtcgagagttaattgatcaaaaggttccgaatgaacaacgagaacgttattttgcaattacggatgttgatgatgaaattttatgggtaccaggtttgcgaaaggcctggttaaaggaacctttcctaaaagataatcaacaatttattatggaatttagaattggaggaagtccccatggacaatgatatcgccagagttttgtacagtaaggcggatataaaggaagcttgcgaacgtttaggtaaacaattaacaaaggactatgcaggaaaacgtcctttaatcttaagtgtattaacgggtgctatgttcttcacaacggatgtcgttcgtgaatttgatgtatattctgaaattgattttatcgatgtttcaagttacaaaggtggcatggcatcaacgggaactgttgatttggtgtcagatttatctgaagatgttaatggacgcgatgttttaattattgaagatatcgttgatactgggcggacattaagttatattgtggatttattatattcacgcaatgcgaaaagcgttaagatttgtaccttcttagacaagccagctggacgtgttgtagaagctaaagctgactacgttggttttaccgtacctaaagagtttgtagtgggttatggattagactatcaaggctattaccgaaacttaccttatgtgggagttttgaagccagaagtttacgaataaaatcattggtcaaagttagtcaaatatggtattatatcgtcaatggtcaagattgtaactgatatttcttgatgccttacaaggaggaactacatgaaaaataacagaaatggcctgtttaaaaatagtcttttctatatcgtagtttttttgagtattatgggaattatcgcggctgtagttggaaagggtggcaatagccaaacttctactatttcgtctagcgaatttgtctcacaacttaaaaaagacaacgtgaagagctttgatattcagccagccaatggagtttataaggttacaggtaaatatcgttctgcacaaaaggatgattcttcagcaggattattcccaggaaccgtttcatctaataaggtgactggattccaaacttcagttctacagaatgattcaacaattaccgaaataactaaatctgcttcagctgatggagttaaggtcacaactaaagaagaagaatcaagcagtttctgggttcaattactagtaacgggcttacctttaattttctttatctttatcttctacatgatgatgggtcaagccggtcaaggtggcggaggtaaaggggtgatgaactttggtaaatccaaggtcaaacctgctgataagagtgcaaataaagttcgcttctctgacgttgcgggtgaagaagaagagaaacaagaacttgttgaagttgttgaattcttgaaagatccacgtaagtttgttcagttgggagctcgaatcccagcgggggtacttttggaaggacctcccggaactggtaagactttacttgcaaaagcggtagccggtgaagccggagttccgttctattcaatttctggttcggatttcgtggaaatgtttgttggggttggtgcaagtcgtgtacgtgacttgtttgaccaagctaagaaaaatgctccatcaatcatcttcattgatgaaattgatgctgtaggtcgtcgccgtggcaatggtaccggcggaggacatgatgaacgagaacaaactttaaaccaattattggttgaaatggatgggttcacgggaaatgaaggagtcattgttatggctgctactaaccgttcggatgttttagacccagctttactacgtccgggacgttttgaccgtaagatcttagttggtcgtccagatgttaatggacgtgaagcaattttgaaagttcatgccaagaataagccaattgatagtgatgttgatttagcagaaattgctaaacaaacaccaggttttgttggagctgatttggaaaacttacttaatgaagctgctttgttagctgcccgtcgtaataagaagacgattgatgctgctgacttagacgaagctgaagaccgagtaattgcaggaccagcgaagaagaacgcagtggttagcaagaaggaacgtcagacagttgctttccacgaggctggacatacaattgtcggtttggtattaaacgatgcacgggttgttcacaaggttacaattgttcctcgtggacgtgccggcggttatgccatcatgcttcctcgtgaagatcaaatgttaatgtcgaagaaagatgctatggaacaaattgctggtttaatgggtggtcgtgctgcagaagagatcatctttgaccaacaatcatctggagcatcaaatgactttgagcaagctactcaaattgctcgagcaatggttactcagtatgggatgagcgaaaaaattggtcaagtcgagttggctgctccggggcaatcctactatggtgaaggtggaccagcttattctgaaaagacagctgcgacaattgacgaagaaattcggcgctttactactgaaggttataacgaagctcgtaagattattgaagagcatcgtgaacaacataagattattgcggaagcattgcttgaacatgaaacacttgatgaaaagcaaattattagtttattcaagacaggcaagatgcctgaaaagaaaactacttctgaatttccgagcgaaaaagctgcaacgttcgaagaatctaaacgagaactagaacgtaaagaagctgaacgccatgatgaagctgctaaggcagttaagcatgacggctcagaaagtgattctgctacgactgtttattatccaaaagacgataacaatcattcagaaaatcaataatttaagaatcgtgggttgcaaaatgcactcacgattttttgatgaaagcgggtataaaatgaaagattatttagttaaaagtattgtaaatgatggaatgtttcgagcctacgcggttagtaccactaatttagtgcaagaagcacaacaacgtcatgattcttggagtgccgcaactgctgcattgggacgttctttaacggcaacactgttattatcatcgtcggttttaaagggcgaagaaaaattaactgtcaaaattaatggtggcggccctaccggaacgattgtgattgatggaaatgcgaacggaacggtcaagggctaccttcagaattcccatgtttcattacctttaaaagaagatcatcatattgatgtggggcaagcagttgggaatgctggggtaatggctgttaccaaagatatgggtctaggagatccatttactggacaagttggcttagtttctggagaagttggggacgattttacgtattatttagcccaatctgaacaaatcccttctgccgtcggcgtatcagtatttgttaatcctgacgaaacggtgggggtggcaggtggcttcttgattcaagttatgccagatgctacagatgatgctattgataaacttcaacaacgtttgaaagaaattccactagtttcagaaatgttacgtgctggtaaaacaccagaggaaattttaaaagatattttcaatgatgatgagattaaatttttagacaagatggatgttaaatttgaatgtgattgttctaaagaacgttttggcgattcaatttcagcattaccattacaagatatcaaagaaatgatggaagaagatcatggtgctgaggcggtttgtcgtttctgcggtaataagtatgtattttcggaagcggatctccaagaaatcattgaccaaaaataagtgaaattggtaagcttctccacaatcatgaatttctgtgatattatattctgcatgcataaaaagtttgacgaggtgaaaaaatggaatggaaaattggggacattacaatcccaaatcaactagttgttgctccaatggccggtgtgactaatactgcttttcgaatgatctgtaaaaaattcggtgcgggattagtggtttgcgaaatgatatccgaccgaggaattatctatggaaacaaaaaaactctgagcatgatgacagttgatccaaatgaacatccaatgagtattcaaatttttggtggcactaaagaaacattagtagaagctgctaaatttgttgatcaaaatactgatgcagatattattgacatcaatatgggatgtcccgtaaacaaagttgttaatactgatgctggtgcccgttggttgctggatcctaataaggtatatgagatggtatcttacgtgacggatgcggttaaaaaaccagtaacagttaaaatgcgaactggttgggatgctaaccatattttagcggttgaaaatgcattagcagccgaacgtgcgggtgcttctgcgcttgctatgcacggtcgaactcgtaaacaaatgtatactggacaatcagattggaatattttaaaagaagttggaagtcagttgcatattccatttatgggtaatggagatgtacggacacctgaagatgccaaaagaatgttggatgaagttggtgcggacgcggtaatgattggccgtgctgtactgggtaatccatgggaattacaacgaatttcagcttatttaaatgatggaacagttattgatgaacctacaccaagagaaaaaattgagattgcaaaagagcatttacacgctctagtagaattgaagggtgaaaatgtcggtccgcgagaattccgtggacaagctgcctactacctcaagggtattccacattcagctcgaaccaaggtggctgtaacgggagcagatactgagcaacaaatgattgatatttttgatagttttattgaaaaactcgaaactagaagagtaagaactttgaattaaggttgcaatttgttgttttagtaggtaataattatatttgaataaatttaagagggggacaaaatagtgggtgaaaagcaacaaccaagtatgaatgaccaactaagagttcgtcgcgaaaagatgcaagaacttcgtgataagggcatcgatccatttggtcatcgttttgagagaacacatttagcagcacaattacacgaaaagtacagtgatatgacaaaggaagagcttgatgaacagggcgtggtagctacgattgccggccgtatgatctctaagcgtggtaagggtaaggtcggttttgcagatcttaaagaccgttctggaaaaatgcaattgtacgttcgtaaggatgttttaggcgaagatgtatacaaagtctttaagcgttctgatattggtgatttcctcggtgtaactggggatgtcatgaaaaccgatatgggtgaattaacaattaaagtaacgggactaactttcttaagtaaagcgctccgtcctcttcccgacaagttccatggtttacaaaacgttgaacaaatttatcgtcaacgttatcttgatttaattgctaatgatgatagtatggatcgtttcagaaaacggactaagattgtttcagcagtaagaagatatcttgatggtaatgattttgccgaagttgaaacaccagtgctacatactcaagctggtggagctagtgcacgtccatttattacacaccataatgccctagatatcaatttatatttacggattgcgttggaacttcatttaaaacggctaattgtcggtggaatggaacgagtatacgaaatcggtcgcgtattcagaaatgaagggattgatactcgtcataatcctgaattcactatgctcgaaacatacgcagcttactttgatttccatgacgtaatggatgaaactgaaggaatttttaaggcagcagttgcagcggtttcagatgatggtaagattacgtaccaaggaacagaacttgacttaggtcaagattttgaacgtctacacatggtcgatgcaatcaagaaatatgcgggagtggacttttggcctaagatgtcggtcgaagatgcgaagaaacttgctgatgaaaatggtatccactacgagtcttggtggacagttggacacatcatcaatgaattctttgaagaaaaggttcaagaccaattgaaacaaccggtgtttatttacggacatccagtagaaatttctccactagctaagaagaacgccgaagatgatcgttttacagatcgatttgagttgtacatcttaggtaatgaatatggcaatgcctttactgaattaaatgatcctatcgaccaacgggcgcgttttgaagctcaagttgcagaacgtgaagcaggtaacgatgaagctgaaggtattgacgaagattatatcgaagcacttgaatatggtatgccaccaacagggggacttggaattgggattgatcgtttagtgatgttactaactgatgctccttcaattcgtgatgtactattgttcccaacgatgaaacccatcgactaaataagaactaagaaaagaatgagaatagcaaaattctcattcttttttttgtgcattttgcgcaaggaaaaagatgtttttttagcttcatgaaatcgttaacaaatcaatttctaatcctttactaagtaattattacttttttaaaataaactattgacgaatcacgggtaaaattggtattatattctagcagcgttagttcgcggcagtcaccgaattagatttatgaaaaattgctaaaaaattgcaactgcagtagccaattcagctttaggatataagtttgcgttggatgctattttgaaattagatgtagaagagtctaaagattggtcgattagtttaaacgatgaagaaatcgatagtattttagataatttaactagtgatctggatgcggaacgcatcgaaatcattgagatattgagagatttatacagtcatattgctttaaatgaaattgtacccaacggacaatccttgtctaaatccatgatggataaatacgataagcatcatgcggatttagatgtattgaaaaaagttatttctaatatggacgatcgaaaaaaagctaaatctttaaaaaatatttacaatcagtatgtgggtaaaactaatgataaagttttggataaagatgaattctataaacaaatccaaaagaatttagataagtctgaagatgctatgaagattgtcaatgaaattgaacttgatcaatttatgccaaaacagcgtacatctcaaaatggagtgattccgcaccaacttcatcaaaaagaattagatgaaatcattgaaaatcaaaagcaatattatccatttttagcagagcctaaccctaacgaaaaaagaaaacctcatgctcaatttaaattagatgagttgatagctttcaaaattccttactatgttggtcctttgattacaaaagaagaacaacaagctcaatctggtgctaaatttgcctgaatgaagcgtaagcaagatggggtaataactccttggaatttcgatgaaaaagttgatcgaatggcgtcagctaatgaatttattcgccgaatgacgactaaagacacgtatttgttaggtgaagatgtacttccagacgaaagcttaatctatcaaaaatttaaagttttgaatgaattgaataatgtcaaagttaacgataagaaactgacagttgctgataagcaggatattttcaatgatctgtttaagaaacagaaaactgtttccgtaagtaaacttcaaaagtactttgttacaaaaaagcattacttgacagagccaacgatcaagggattatcagatacgaagaatttttctaatagcttatcaacttatattgattttgaaaaaatatttggaaatgaaattcttgctgatcaaaataagcaaaatgatttagaaaaaattattgagtggtcaactatttttgaagatcgtaaaatttttgaagataaattgcatgagattgaatggttaactgaaaagcagattaaagctattcggagatatcgtggatggggacggctttctaaaaagctactagtcgatttaagaaataatgaaggtaaaagcattttagatgaactttggcgtaccaatgataactttatgcagattcaagcacgtgaggaatttgctaagtcgattgtcgaagctaaccaaaagttaatgaatcttggtggagctgccagtgttcaaaatactgtggaaagtaccttagaggatgcctatacctcaccccaaaataaaaaggctattcgtcaagttattaaagttgttgaagacatagtcaaagcggttggctacgctccagagaaaatcacgattgaatttactcgaggggcagataaaaatcctagacggactcaaaatcgtcaaaagcaaatcatggaagtatataaaactgcggctaaggaaatcgtagatgcaactttgaagggacaacttgaaaatgaggaaaagttaactgataagttatatttgtatttcacccagttaggtaaagatatttatagtggcgaaacaattaatatcgatcaacttaataattatgatattgaccatattttgccacaagcttttattaaagatgattctctggataatcgagtgttaacgagtcgggctttaaataacggtaaaagtgatagtgtgcctgtgaagcagtttggcgcaaacatgaaatcattttggatgagactccaagcacatggattaatctcaaaaagaaagcttgataatttaatgacagatccagacagtattggaaaatataccatgcaaggatttgttagaggacagctagttgaaactagccaagttattaagttgactgcaaatatactaggtgccatctacggggaaaatactgatattgtggaaatcccagcgaagctgactcatcaaatgcgggagaagttcaatctgtataaggtgcgtgaggtaaatgattatcatcacgcctttgatgcgtatttaacgacctttgttggtaactatttattcaaacgctatccaaaactacgtccttattttgtatatggcgatttcaaaatgactgataatgccttgaaagggatgcgtagattcaatttcttacatgacttaaaagatgatgaagtattagtagataacaaaactggtgaagttttatgggaaggtcaaaagtctattgaagagttgaagaagatttatggttataagtttatgttaacgactcatgaagcatatattaataatgggacaatgtatgatcaaacagtatatccagctaaatctaacaaaaaacttattccttcaaaaaacaatagaccaaccaatatttatggtggattcagtggaaacaaagatgcatatttagcaattgttaagattcttggtaagaagggtgatacctataaagttgtgggtgttccaagaagattttctgatgaattgttaaatgcttataatgatgactactcagaatatttaaataaattgcatgatgttttggtaacacaatttacaaaaaaacaaagaaataagaagactggtaagataattaaaaagattgagaattttgaaattgtagtgggtaaagtcaactatagacagagaattattgatagaaaccagagcttcatgctcggaagctcaacatacaagtataatactaagcagttagtgttgactgaaagctcaatgaagatattatctaactttaagcacgctagtgatgataatttgaatttagtttatgatgaaattttggaaaaagttaatgagtcatttgaattatacgataagaatgggtttagaaaaaaattaaataacaatattgataaatttagaaaattaccatgtaaatctatttttgaaaagaataaattaatttccgttggaaaatgtgaaattttattccaaatactaaatgggctacatgcgaatgcaacgatgggagatttaaaaggaatcggattttcaactccatttggttttatgcaagatgcaagcggaataaaattaaataaggattctatgctattgtatcagtccccaaccgggttatttgaacgcaaagttaaattgagcgacctttaaggaacgcaagaaaaagaggaatcaaccttaaaggtgattcctcttttattatgtaatgcccatataatgggacagatgtgtaaactccgcgtaaagcgttgtttgatttcaaaacagaatgttaaatcaataagtttaagtacgttgggagctacccaacaacataaatatatacttaaataaaaataaaatcaaggagaaatttatatgggatggcgatcaataattatcacacagcatgctaaactatcatattcttcaagaacaatgatagtccaaaccaatgatgggattaatcaaatccccatcgatgatatcagtctattacttatttcgaccacgcaagcagtcattacgacagctctaatcagtgaattatccaagaaaaatgtaaaaataattttcacagatgatactcacaaaccaattagtgaaacttatggatattatccaaatcatcgaagtgcagggctattaagagaacaacttaattgggaaattggtcgttcccaagtgttgtggacaaaagtggtagctagtaagttgatcaaccaaattaatgttcttaaattacagaatgttaaaactagtagtctagaggatgaattaaacaagttggaattaaatgatattactaatagagaggcagttattgccagaaagtattttcctttgctttttgaagatggattttccagaaggaatggaagtgtaataaatacggctttaaattatggttattctattttattatccacaattaatcaggaaatcgtttctaatgggtacctgacatatatcggaattcatcatgacaatgaggaaaatcaatttaatttagcgtcggatttaatggagccatttcgtcctatcgtggatttttggctagctaataaaaagtttaacgagtttaccccagatgtgaaatatgggctagttgaattactgagcttggaaattaaatataatggcaaaaacacgttattgcgaaatgcgattacgatccatgttagaaactgtttgaaatacctatcaaataaagaacaaaatataaaaattgaaatggagttattagatgaggtaccaaatcatgcgattaatgataatgtttgatctaccagttgaaacggctaaacaacgaaagcaatatcgtcaatttcggaaatcattaattaatgaaggatttttaatgattcaatactcagtttatgtgagagtttgcgtaactaagaaatcagccacattgatggaaaatcggataaagaattttttaccagaaaatggaacgattcaagctcttaccttaactgaaaaacagtataacgatatgcatttcttagttggagatagagtagaagatgttcgaaataattcagatcggacggtaattttatgaaaattacatataaaactcatgataatttagaaattaattctggacagatatcaattttaggaactaatagtccaacggtctatactgatataatacaaggattacaggacgaaaacgaaaaaatcagcatagtcgatgaaaattatagtgcattggaaatagcgcacgcaatcgattggatcggagatgttggtactcagaatttagttttaacaaaatatttgcgccaaattgaaaagttatttttacggtctgttacagatgaacagcaaaataaaattcatgatgaaatcaatcgtatatttaacatagtttccgaacaattatttttactagatttaccgatagaagttaactttgattttgatcttaaaaagttatttaaatattgcgggattcgatttgatccaattttaattagtaaaccatatggtataattgaaacaataattaaaattcatgaaactagtaatcttgactcgtgtatagcgttaactaatgtagctcattatttaacgccagtcgaatttgaagaacttagccagttagtcaaagagacgaatcaaaaaatactactaatcgaattcacagaaatagaagagcagagcttctatggaaacgctgaattctactacattgatactgattttattgattggcacaactgaaaccattatttttttatgagaaattaatggtttcagaagagtgttaaatcaataagttcaagtactatcgtctgagtgatcatcttgtaatttaagtttcagaagagtgttaaatcaataagttcaagtacacctagaaggcgaattagcaaacattcaaggtttcagaagagtgttaaatcaataagttcaagtacgtggtgacacaccggtaacaaagaagttcagtttcagaagaatgttaaatcaataagttcaagtactgctacattctatggccaagatgtgtcgttgtttcagaagaatgttaaatcaataagttcaagtactaaatttcgccattaagcttcctccagttcgtttcagaagaatgttaaatcaataagctcaagtacttctgccggcggaatccactaaatttgtttgtttcagaagaatgttaaatcaataagttcaagtacttattaaaaagtgccttatctcctgtcactgtttcagaagaatgttaaatcaataagttcaagtactttgacccagtcgttgcttgaaccatctgagtttcagaagaacgttaaatcaataagttcaagtaccgcgcgccgttatatctgaattttctatcagtttcagaagaatgttaaatcaataagttcaagtacttaaaaactaaaacgtctaatgataatctggtttcagaagagtgttaaatcaataagtctaaaattacaaactgtacctccgcaacaacttagccagctgttgtaattttccacaactagttcgacagtccaaaataacaaattaaaaagaatcattttagccactaatacttagtgaaactaaaatgattctttttgttatttaattactaacggtaaaataacgaccgaattcattaaaatatgagcaatcatcgaagtttgaatacggccggtctttttgtacaaccagcagaatagcaaaccaatggccgcatatagaaagatgtgactatcgttgtgcataaatgcaaaggctagactagaaatgatggccatgacggtgaatcctagtgtggaattagctccaaacatcgcactgagattaccaaataaaacttttctaaaaaccaactcttccatgattggagctcccacggtgatcgctaaaatgaaaaatggattggttttagccaaagtcaccaaggttgcggtgttttgagaagtaggattacttccaaaaataatcgtaatatagctaatcacaaattgcagcaaaattactaaggctgttccaatgattccccaagcaatagcatatagaaaagatttacgattagattcgatatggttgatttcattggttttactactaataaagattagtagcagtgcgccaatcaagtagtcgacagtttcaacccagataaatccagcccccagattaataaacacgtttaaaatgccaggtagaaggaaaattattaaatacgtaattaaagttaaaattgaactcttagaaattttcatctcaaccctcctttattcctgatagtatagcatatttaaagcattgctaaatttgattggttaataaaggtcaaaaatacttgcaatctaaaaaaatcatgatatagttatcattgtagttagcacttagagatgacgagtgctaaacaaatcttatcagtaaattatatttggagggattcacgtgttaaaacctttaggagatcgcgttattttagaagctaaagatgaagaagaacaaactgtcggaggcatcgtacttgcaagcaatgctaaagaaaagtcccaaactggaaagattatcgctgtcggtaacggtacagttttagacaatggtcaaacagtaccaatgaacgtcaaagttggcgatacagtagtatatgacaaatatgctggtactgaagtttcatacgaagataaaaaatacttagttgtccatgaaaaggacttagttgcagtagttgaataattaatttttaatttaggagtgttgataatggctaaagaaattaaattttcagaagatgcacgtacaaaaatgcttaagggtgtagataagttagctgacaccgttaagtcaacaatcggacctaaaggccgtaatgtggtcttggaacaatcatacggttcacctacaattactaatgatggtgtgacaattgctaaggcaatcgaacttgaagatcattttgaaaatatgggtgctaagttagtttcggaagttgcttcaaagaccaacgacattgctggtgatggtacaactaccgctacggttcttactcaagcaatcgtcaatgaaggaatgaagaacgttactgctggtgctaaccctgttggtatccgtcgcggtattgaaaaagcaacaagtaaagcagttgaagctctccacaagatgtcacatgaagtaaagactaaagatgatattgctcaaatcgcttcaatttcttctgctaacccagaagttggcaagttgattgctaacgctatggaaaaagttggtaacgatggtgttatcaccattgaagaatctcgtggagttgacacaacattggatgttgtggaaggtatgcaatttgaccgtggatacatgtcacaatacatggtaactgacaacgacaagatggaagctaaccttgataatccatacatcttaatcactgataagaagatcggtaatatccaagatattcttccagttcttcaatcagtagttgaacaaagccgttcattgttgattattgcggacgacattacaggtgaagcactaccaacacttgttttgaataagatgcgtggaaccttcaacgtagttgcagttaaggctcctggctttggtgatcgtcgtaaggaacaattggaagacattgctatcctaactggtggtactgtaattacagatgaccttggtttgaacttgaaggacgttactatcgaacaacttggtcaatctaacaaggttacagttactaaagatgatacaaccatcgttgaaggtgccggaagccaagaacaaatcgctgaacgtgttggaattatcaaacaacaaatcagtgaaacaacttctgacttcgacaaggaaaaacttcaagaacgtcttgctaagttatctggtggtgttgcagtaatccgtgttggtgctgctactgaaacagaacttaaagaaaagaaataccgtatcgaagatgctttaaatgctactagagctgccgttgaagaaggttttgttcctggtggtgggacagcacttgctaacgttatttcagaccttgaagacgtcgaagctgaaggcgatgaagctacaggtgttaacattgtacgtcgtgcgcttgaagaaccagttcgtcaaattgctgaaaatgccggcgaagagggttcagtaatcgttacaaaacttaagggtcaaaagccaggtgttggatacaacgccgctaacgacgaatgggtcgacatggttgaagccggaatcgttgatcctacaaaggttacacgttcagcacttcaaaatgctgctagtgtatcagcattattgttaactactgaagcagtagttgctgacttaccagaagacaacccagctcctgcagcaccagctccaggtatgggcggtatgatgtaatttaattcttagaactaacgatttaaattaggaagatgcgaaggtttgccgaaaattcagctctccaacgctaaactagactaatttaaattaaaagaatccatgatgcgatcagcattgtggattcttttttatttccaactaggagaatatgaattagaataacttagaagttgaaaaacttctttactggactgaggaatattacgtttaaattacaccttattcagatgaattctgttattatcagtatatgaattataatcttaaaaattgtgctagtcattttgcgagatttggagtagaatttcacttgcatatttttgaaaatggagagtaaaagatgttttcatatttgaagcgtattttaattggtaaaccactgaaaacgctcgacgagagtggacaagctttaacaaagttcaaagccctcgccttgctatcttcagatgctttatcatctattgcatatggtaccgaagaaattttgtcggttttgattgttttatctgccgctgcaacttggtattcaattccaattgctgggattgtattagtgctattattcgcgattaccgtgtcataccgccaaattattaaggcttatccatctggtggtggggcgtatgtagtagctagtaaaaattgggggacgtctgccggtctggtggccggtggctcacttttagtggattacatgctgaccgtagcggttagtgtgacctctggtacagaagcgattacgtcagcgattccagcattgcaaaagtaccatattgccattgcggttttgattgtactggggattatggcgctgaatttgcggggactacgagaatcagctagtttcttaacgattccggtttacctatttatcgtggttatttccttgatgattgtggttggtttatacaacattgcaactggtcaagtggcttatcatgcggcttccgcagtgggatcggcagtgcccgggatgacttttgtgattttccttagagcactatcgtctggttcttcttctctgactggggttgaagcgattagtaatgctgttcctaactttaagaaaccacgtcgtaagaatgctgcaggaaccttagccattatgtcattgattttagcttcattctttgctggaattacgttcttggcatactatagtggaattacaccaagttcttctcaaaccgttttatctcaaatcggtgtgacaatttttggacatggtattttctactacatccttcaattatcaacggcattgattttggccgtggctgctaatactggtttctcagcctttccaatgttggcatataacttagctaaagataagtttatgccacatgcttatatggatcgtggtgaccgcttaggttattccaacggtattatctccttggctgctggagcgatcgttttgattttaatttttggtggacaaacaggactattgattccattgtatgccattggggttttcgtacctttcacattgtcacaatcaggaatgattgttcattggaagcgtgaaggcggtaaaaagtggatgataaatgcttccgctaacttgctgggagctttactatcagccgttttagtaatttgtttgctattcttacactttagcaatgtttggccatactttattgttatgccactcttgttaagaatgttctacaagattcgtaaacattacgatgaagttgctgatcaattacgagtaattgaaaaaggtaaagttaacttgcacgactatgatggttcaactgtgattgtcttagttagcaacgttactcaagttacttctggagcaattaactacgctcgttcaatcggggactacgtaattgcaatgcatgtctcttttgatgctaatcctgaaaaagaacataagaccgcgatggaatttaaagctgaatatccagatgtacgtttcattgatatccattcatcttatcgctcaatcacgaatccaaccttacgtttctgtgatgtgattgcccggcgtgcggctgaacgaaactacacaactactgtgttagttccacagtttgttccaagaaaaccatggcaaaatattttgcataaccaaactggtttgcgtttacgtgcttctttgaactcacgtgagaatattattgtctcaacctataattaccatctgaaataaataaaaagtaaaacctagctgaggctaggtttttttgtgtcaaaatatgaaaaaataatttaaattctttgcatttttagtgaagaagattgtataaggctcatgagtttaggtataatgtgcttattacgaacaaaaagaggacaaattatgcgatttgaaataattgttagtttatttgcgacaatgatcatttcggcgatcttaacaccatttgtccggaggatttcattcaaagttggtgccattgacaaaccgacagctaggcgagtcaataaagtaccaatgccaaccatggggggattggcaatcttcattgccttcaatttctcattatttttcttattgagaaatcaaatacctaatccgcagttttacggaattttcttcggggaatgcattattttagtaacaggaattatcgatgatatttttgaattaagacctatacaaaaaatgattggaatcttgttagcggcgttagcggtgtatctatttgctaacgttcggatgacgacgttaactttcccatttattggaattgttaacttcgggtggttttcgttaccaattacgttgctatggatagcagctattacaaatgcgattaatttattagatgggttagatggtctagcgacgggggtaacaatcattgcgttgtttaccacaggatttaccggactattctttctaccatctactaatatctacattgtaatcatgatttttaccttggtagcagctgaaattggttttttaccttacaatttctttccagcacggatttatctcggtgatacgggagctttatttatcggatttatgatttcaattttctcattatctggtttgaaaaatgcaacctttatcacaattttaattccagttatgattttgggtgtgccattgactgatacggtttatgcaattttgagaagattattaaataaggaatctatttcacacgctgataaacgccatctacatcatcgtttgatgcaaatgggcttaacccatcgacaaacagtgttagtgatttatggaatttcactaatcttttcctttattgcgctgctatatcccgtttctacgttgtggggctcagtattgttaaccatcggaattttgattggaatcgagatttttgtggaagcaattggattagtgggcgaaaaccgtacgccaatgctaaattggattcgaaagctcgtacgctctaatacttctaaagtagatagtaatgaatttaaagaagagaacactttaaaagataaagttcgcacacgtagtgaacgccataaaaaatgaggataataacgatattagtcgttgtcatcctcatttttttgatatggaatttgaactcgttcggtacctaaatccttaaaggccacattcccactaaaaagaccgattagttctttctttaagggttctaattgttctttggaaattgaaatagtagtagttacttgggtagtgtattccgtttctaactggtttaaatgatgttgttcaagataataaactaagtgatcattgttttgataatcaagtttaatcgataaaagctcttgatcaacaagttgaatcaaagcagcattattaacggctagggaagtacttgatccataggcgcgaattaaaccgcctgctcctaacttaatgccaccgaagtaacgcgtcacgacgatcaatacattggttaagttctcgcgttttaaaacctctaggataggagcgccggctgttccagaaggttcaccatcatcagaggcccgttggatatcttgctggtcacccaaaatgtaggcaaaacagttgtgattagctttagcttcgattgtgcggatttctgttaaaagttgattggcttcctcttcgctttgaatgggaataatccgagtaataaatcttgattttttgatatcttgttcaattttaaaactttctttgacggataagattggtttcaagaaaaagactcctttttaggtatttaacaaatatgaaagaaatagaaaagcaaaaatactatggacggctggttttacagccaattaatgcagtaccaacggatgcgcttgattgtcgaccagcaattgtaatgaaaggaaatcaaattcactgccaacgatgtggcgcaattacctctagtagggatggggcattaccagatcatcaattctattgccgtaaatgtatcaacttaggtagagtttctaccctggttcagttagcgaccattcctgagcctaataattttgtggcgaatcagagttatttagaatggccgggaaagttaactgctccgcaagctcgctgttcaaaagcgattattaattccattgatcagcaacagaatcgtttactttgggcggttactggggcagggaaaactgaaatgctcttcccgggaattaatcatgccttacaaaagcaaaaaagaatatgtgtggcttcgccccgaattgacgtggtcttagagctgtttcctcgatttcaagaagcttttccacaggctaaaattgccttgcttcacggtcgatccccagctccctatgaatatacgcagtttgtgctctgtacaacgcatcaattactacgattttaccacgcctttgatgttttaatcattgatgaagtggattcttttccctatgcgatgaatcctgagctgcattatgcaaccaagcaggcccgtaaattacaaggatcgaccatttatcttacagctaccccagacggaaaacttttacagcaaagtcggcaaactaaattagccaccagttatctaactcggcgttttcatggacatccactaccagaaattaaagtagtgagtgggcaaaattggatgaaaaagttaagaaagggtcgattgccaagcccattaagccgatttattaaggaacaaattcaagcacagcgccaatttttaatctttgttcccaaaattgaggtgctatcgaaagtattggaggctttgcaacaggtctttcccacggtcaaagttttaacagttcacgcagcagatccagagcgggtggctaaagtgcaaatgatgcgtaaacaggaaattgacgctttaattacgaccactattcttgaacgtggagtgacttttccgggtattgatgtcgctgttttaggagcagatgatgccgtcttttccatggcagcattggttcaaattgctggtcgagttggtcgaagtccccaacgacccaaggggactgtattatttatttgtccaatgttaaatcgaaatataaaaagagctcaagcccaaatcaaatttatgaatcgaaaggcgagtgaatgttgaaaagttgcttattttgtaaccgaggattaaataataatttagatttatcttttattttaagtttcagaaaaattactccaaagttagtttgcgaggggtgtataacgagtttttccacattagtagatcacaaaacgtgtattagatgtggaaaactttcagcaatcctcgagtgtgcggactgtcaacgatggaatgatcagttcgtaaatcgagccatgtttcaatatgatgaggcgatgcgtaatttttttcagcattataagtttcagggagattatttactgagaaaagttttccaagatcaatttgttaattttattcaaaagatccttaaagaaaacgagttgattgttccgatcccagttgatgagagtacaatgatctcacgtggatttaaccaagtaactggattgatggaaggtctggattggaaagatgttttgattaatcagcgctcaaacgatagtttacatcaatttcaacgttcaagaagagagcgactacagcaagatagtccttttgctttgaaaagcggatgtgatattagtggtgaacatattttgttggtggacgatatttatacgaccggagccacccttcgacaagctcggaccactttactaagaaatggcgcgacccaagtccgttcagtcatgctttgtcggtagttatttgggtatattcattgtttattgtagcgttttcatttataatgaagttgtacagaaatacatgaagtagaatatatatttctgttagtggatgcagtttatccacagttgaaaggagagaagtcttatgcttgattttaatgtacgtggtgaaaatattgaggtaacagaagcaattcgggattatgttgagaaacgaattggtaagattgaaaaatactttgaacaaggtgccaatccaaaggctcacgttaacttgaaagtataccaagacaaaacggctaaggttgaagtaacgattccattgccatacttggtattacgagcagaagaaacttcgcctgatttatatgcgagtgttgacttagtaactgataaattggaacgtcaactacgtaaatacaaaacaaaaattaaccgcaaatcgcgtgaaacaggatacaaaggggttgaaatccctagtggtgatattgtagagaacgaagaggaaaccagtcaatttgacatcgttcgtactaaacaagtgtccttgaaaccaatgggaagtgaagaagcaatcttgcaaatggacatgctaggacataacttctttatctatgaagatgcagaaagtggatcagttgatattgtttatcgccgtcgcgatggacgctatggtttgatcgaatctgctaacgattagatccgctaaataaatacaaaacaaaattgcttaacaaacttccaacggtttgttaagctttttaaatatatttaagattagtttgattgtaataataaaaatgataaacttaaacaggttatcgtttttacgattaagttagtacggaaggaaatagtacatggcaaacattttaaaaaaatgggtggaaagtgatgcgcgtgagttaaaaagactcggtaaaaaagcggataagattgaagccctaaaagaagaaatggaacaactaaatgatgaaaaacttaaggctaaaactacagagtttaaagagcgtctacaaaatggcgaaactttagatgatattttagttgaagcttttgcagtcgcacgtgaagcagctaagcgagtattaggcttattcccattccgcgtccaattaattggtggaatggtacttcatggtggtaacattgctgaaatgaaaactggtgaaggtaagactttaacggccacattacccgtgtatctgaatgccttaggtggtaaaggggttcacgttgttactgttaatgaatatttggctgaacgtgactcaagtgaaatgggtgagctttataaatggcttggcctaacagtaggggttaattcttcagaaatgactcccgaccaaaaacgtgaagcttacaattgtgatatcacttattcaacgaacagtgaaatcggttttgattacttaagagataacatggttgtgtataaagaggatatggtacaacgccctctaaacttcgccttgattgatgaggttgattcaattttaattgatgaagccaggacacctctgattatttctggtcagactgaaccaactgttacgctatatgaacgtgctgaccgttacgtgaagactttggctgatggtgattacacgattgattgggaatcaaaatccatctcattaacagaaaatgggattcgtcgtgcggaaaacttctttaaaaccgacaacctctacgatgttgaaaatagtgcgttgaaccatcatattgatcaagctcttcgagcaaattatattatgactaaagacaaggactacgtggtttcagatggtgaagtcttaatcgttgattcttttacaggtcgtgtaatggaaggccgtcgtttttctgatggactgcaccaagcgattgaagctaaggaacacgttgaaattcaagatggggctaaaactatggccaacatcacttatcaaaacttgtttagaatgtatcgtaaactttcagggatgaccggtacagctcggactgaagcagaagaattccgtgaaatttacaatatggaagttacaaccattccaaccaaccgtccggtggctcgtgatgaccgtccagatttactttatccaactttggaaagtaaatttaaggcagtggtgaaggaaatccgtgatttgcatattaaaggtcaaccagttctagttggtacggttgcggttgaaacttcagaatacctctcacgcttgcttgatcgagaaggtattccacatgttgttttgaatgctaagaatcatgcccgtgaagctgaaattgttaccaacgccggtcaaaagggtgcggtaacaattgctactaatatggctggtcgtggtactgatattaaattaggacctggcgtagttgaactaggtggtttagctgtaattggtactgaacggcatgaatcacggcggatcgataatcagcttcgtggtcgttcgggacgtcaaggtgatgtcggaatgtcccaattctatctttcactagaagatgacttgatgattcgttttggttcagaacgaatcaaagatttgctttctaggatgaaaattgcggatgaagatgcagttattcgaagtggtttaattagccgtcaagttgaatctgctcaaaaacgagttgaaggtaataactacgatgctcgtaagaacgttcttcaatacgatgatgttatgcgtgcgcaacgtgaagtgatttacgctgaacgtcaacaagtaatcatggaagaaactagtctaaaagatgtgctaatgccgatggttgatcgaacgattgaccgcgtggttcatgcccatacccaaaaaactcaaaagaactttgatttagaaaccattgtagaatttgcacgaactgccttggtttcagataaagacattcatcaagctgatgtggaagggatgtctgctaaagaaattaaggactacttgaaacaactagctgatcaaatgtacattgaaaaagaaaaagctttgtacgacccagctcaaattctagaatttgaaaaagttgtgattctccgagtggttgaccaacactggaccgatcatattgatgccatggaccagttacgtcaatcggttggacttcgaggctatggacagttaaatccattagttgaatatcaacaagaaggttaccgaatgttcaacgaaatgattacagatatcgaatatgaaactactcgattatttatgaaatctgaaattcgtcaaaatcttcaacggtagttgatttataatataaaactgggaaggtaatttgaccgttcccagttttttaatgtgaaatgaaaaaaggagctaacttatatggagctagttgaagcaaaacatcaaattgaagatatgaaaaaagaagtcgttgacttcgggaggtctctttgacttagatgctttgaatgaaagtatcagtgtcaatgaggccaaaatggcagagcctaacttttgggataatcaagaacaggctcaaattgtcatcaatgaaaataatgagttaaaacaaaaatacgataattttaaaaatttaaccgaccatgttgaaaacttagaggtaactgctgaattattggaaatggaagatgatcctgacgttcaaagcgagtttgagagtgaattagccgccacggctaaattattgcaggattaccgtttaggattattgcttaatggtaaatatgatgccaataacgcaattgtagaaattcaccccggagcgggaggaacagaatctcaagattggggttccatgttgctaagaatgtacacgcgttgggctgagcagcatcagtttaaggttcaaattgaagattaccaagcaggtgaagtggcaggaattagcagtgtaaccatgcgaattgtgggtcacaacgcatatggttatttacgctctgaaaagggagttcatcggctagtaagactatcaccatttgattctgctggacgacgtcatacttcttttgcatcagtcgacgttatgccggaattggatgattcggttgaagttaacattaaccaagatgatttacgggtggatgtatatcgttctagtggtgctggtggacagcatattaacaagacttcttcagcggtgcgaattacgcatttaccaactggaattgtagttgcgagtcaagcagaacgttctcaattacaaaaccgggctaccgctatgagtatgttgaaggctaagctatttgagcttgaagaacaaaagaaagcagaagaaaaggctaaaatagaaggtattcaacttgaaataggatggggatcgcagattcgttcttacgttttccatccctattctatggttaaagatcatcgaagcaactttgagacggctaacgttcaaggtgtgatggacggggatctcgatgattttatcaatgcttatttgcaatggaaattgaaagaagataatccaaaatagggggattcggatgtcaaagacgatattagttgtagatgatgagccagcaattgtgactttaattacttataatttggaacaagctaattatcaagttgtgagtgtggataacggtttagatgcggtggaaatcgtccaaaagggcttagttgattttgtgattatggatttaatgctccctcaattggatggaattgaagctaccaaacaaattcgcaagtttgatgaacaaattccaattattatgttgacggctaagactagtcaagttgataaaatattgggattggaattaggggcagatgattatattaccaaaccatttagtcctcaggagcttctttcacggattaaagtaatcttgcgacggactgatcgggcaattaatttggctgaaattgatccaactctacaagcagaaaatatcgccattgatttcaaaagaatggtggttaagaagaataatgaaaaaattcaattaacacccaatgaatttaaactattaaggtatttatacaaaaatgccaaccaagttttatcacgcgatcaaattttggaaaaagtttggggatatgaatatgggggacagacccgtattgtggatatccacatcagtcatttgagggataaactggaaaatgatcccaaacatccacagttgatcaaaaccattagggggtttggatatgagttcgtctcgaaaaaaggcgattaagcgtaccgtgcaattcggttttgctagtctaatcggaaatgcctttatggcttttctggtgtataaattaattgtaaaagaaaatccacgagtaactaaggtagatatgacactgttaatcgccgtgattttattaattacggttattgaaataattgtattttggagtaatcaaaagaaaattattgagcgtcaaaagttattcagaaagaacttagaagaagttattaaaggtaaccatgttcccaagattcaattggatccagaagatccattttataaattatctaaagttgttaatgaaattggtacccatgagcgtcatcaaattcacgttttgagaaatcaacaaagtgaattaaccgccattatggataatttgccagtaggagtgctagttatcaatcggcaccgtgaactacaagtggctaacacgtacgctattaaccacttagggattactggactcgacgttcctcacccatataccatggatattcgggatcatgaattaagtgaattggtggataacgtgtttagaacacgccagagtactaccaaaacaattaaactagatggggaccagccatatatttatgaaacaacggttgtttacagtcccaaagtgcaccataaatttgaaattattgtgctactttacgatgcaacggaaacggtgcgctctaaacaaattgaacgtgactttgttaacaatgcttcgcacgaacttcgtacaccaattacatcgattgcgggcttcgcagatacgttactaaacggagccaaggacgatccagaaaccttggataatttcttacgtattattaaggctgaaagtgataagttagtgcaattaacggacgatattttaaccatgtcgcgcgttaagagtggtgaacgagaacgtaaagaaattaatttacataagtatgtggatcaacaacttaagttagtagaaagtaacatcagtagcatgaatctacatgtggaaaacaatattccagcagatgttaatgaagaagtgattgaaaatgatttattccaaatcgtcaagaatttgattactaatgcgattagttacaatcgaaaaggtggaaaaatcaagattgattacggatcacatcatgaccgttggaagctcgtagtgagtgatactggtattggaattcctttaggacagacggaccgcgtttttgaacgtttttatcgggtgaataacgctactaaaggtggtactggattaggtttagccattgttaaagaagcggttgacgatatgaatggtagcgttcgaatcgaatcagatgaagatagcggaaccacggtgatcgtaaaattcaagcgtgatattaattaaatattgtggaataaagttgaattttaattcggctttatttttttttacactttttactattttaaaattctttacataatctttacatacctcatatttaacctttacgttgcccttgtatgctaataatcgaagctagagattagggaaaagaggccaggacatgaaaaaagttaataaggggattatcttagcgtcgatgatggcaatactcttgattttgactggatgtcagtctaagtcatctcaaaaaaattcagtaacgattgtgggatcgacggcgttacaaccattagtagaaaaagctgctgctgattatcaagtaaaaaatagcggtgtggatatcactgttcaggggggcggatctgggaccggtctaagccaagttcaacaaggcgccgtaagtatcggaaattcagatgtttttgcagaacaacaagatggaattgatgccaaaaaagtggtggatcataaggtagcggtggttggaatggctcccgtggtcaaccaagatgttccaattaaaaatatttctatggctaatctacgtaaagtatttacaggtaaaattacaaactggaaacaactggggggacccgatcaaaagattgtggtcatcaatcgagctcaagggagtggtatccggaaatcattcgaacgagtggtattaaaaggacaaccagctttgaatgctcaagaacaagattcaaatgggacggtacaaaaaattgtacaagcaactccaggatcgattagttatctttcattctcatattttaataaccaaattaaacatttagcgattgatggagttcaacctaacgctaaaaatgtggaaaataatcgttggaaaatttggtcatatgagcacatgtatacgaaacctaatgccagtgcagcaaccaataactttattaaatacatgaaatctgaaaaagtacaaaagaatttagtttcagacttaggttatatttcaatccatgatatgaaggtagaactaacaagtgatgaccaagtaatcccaattaaaggagctgaggaataatggatgcagtaaaaaaagaattaacgcgtaaatcaaaggcttccaggcaggaccagcgtggaaagttaatttccttagcttgtgtaactttgattatgttggtagtcctttcaattttatacatgattacttctaaaggtttagcaactttcttcgaaaataaaatgagtattgttgatttctttactaagcaggtttggaatccgagtgctaaacctcaagcgttagtgggcgcactaccgatgattgtaggatcattcagtgttaccgttctttcagcccttttggcagcgccatttgcgattgccaccgccatcttcatggttgatattgcaggaaaacgtggacgtaaaattttacaaccggtcatcgaattgttggtgggaattccatcagtggtttacggatttatcggattgacggtcgtcgtgccctttactcgaacagtatttggtgggactggttttggaattttgtcgggaaccttcgtactgtttgtcatggtcttaccgaccgtaacttccatgtacgttgatagtttaaaagctgttccacagttttatcgcgaggcttcattggctttgggagccacacggtggcaaacaatctacaaagttatcattcgagcttccattccaggcttactaactgctattatttttggaatggctagagcctttggtgaagccttagctgttcaaatggtaattggtaatgcatcgattttaccaagtgacttagtatcaccagcctcaacgttaactagtgtgttaacaacgggaattggaaatacagttttagggaccttacctaataatgccttatggtcattagcattggtgctcttactaatgtccttggtatttaacctcctaacaaggtttattggaaagaagggagcattttaaatgaacgctaagagagttgataagattgctacagccgttatttatctattagttggaatcgttattttaattttagtggctctactaggttttatcttgattacggggttaccacacgtcacctggtcatttttaacctcaccagcatcggcatttaatgctggaggcgggattggtgatcagctctttaactccttttatctactatttctaaccttgttgatttcttttccaatttcgcttggagctggaatttacttagcggaatatgcgaagaaaaatcgagtaactgaagctattcgaattaccattgaagttttaagttccttaccatcagtagtagtggggttatttggatttttactcttcgtagtgcaatttaaattaggattctccattatctcaggagcgattgctttaaccttcttcaacctaccgctgttaactcgaaatattgaaaattctttaaatggtgtttctaatttacaacgagaggcggggctttcattaggactttctcgttggaaaaccgttactaaagtggtcgtgcctgctgctctaccaggaatcataactggaattattttaagtgctggacgcgtttttggagaagccgccgctttgatttttaccgctggacagagtgctccagtattaaactacgtaaattggaatccttttagtggcgacagtcccttgaatattttccgtcctgccgaaaccttggcagtgcatatttggaagattaataccgaaggaatcatgcccgatgccagtcaagtttccgccggggcttctgcagttttaatcattgcagtattagtctttaatcttggggcccgttgggcaggaaattatgtttatcgtagaatcactgccagcaaatagaatttggaggaaagcatatgttggaaacgaaacgtaaagaaaaatcaattttgaccttccccgccgatcgcgaaattgctttagaaacgaataaccttcaggtctattatggagataaccatgccatgcaggatgcatctttgcaattccctcgttattccattacggctttgatcggcgcttctggatcggggaaatccacttacttgagaagcttgaaccggatgaatgacggcattgctcgcgtagatggcgagattatgtatcgaggattggatgttaatgcggatgaagtcgatatttatcaaatgcggcgtcggattggaatggtatttcaacgtccaaatccctttgccaaatcaatttacaacaatatcagttttccattacgcgaaatgggtattaaagacaaatcaaaaatcgatggcattgtagaatcgagtttaaaacaggcggccttatgggatgaagtcaaggatgacttgaaacgtagtgcgttagcattgtcaggggggcaacaacagcgactatgtattgcacgttcactggcaatgagtccagatattctattgatggatgagcctgctagtgccttagatcccatttcaacccacaaattagaaatgactttaaatgacttaaaagaacaatacaccattattatcgttacacacagtatggaacaagcttctcgactaagtgattacactgcttttatgcacatggggaaaattgttgaatttgatacgacagaaaatatttttactaatccagcagttaaattaactgaggactatgtctctggaaactttgggtagttaggagaaaaatatggcaaaagatattattacggctgaaaatgttcatttatattacggacaaaaggaagctctgcatggaattagtctcggcttccctgaaaaagaaattaccgctctgatcggaccctctgggagcggaaaatcgacgttcatcagaactttaaatcgaatgagcgatttaaaccccgaagttacggttaccggagccatccgacttgatggcgaagacatctattcgcctaaaacagatacggtagaactgcgcaaacgagtcggaatggtatttcaacagcctaatccttttcctttttcggtttatgataacgtaacttacgggctacgactcagtgggataaaagataaggcactgttagatcaacgtgtggaagaaagtttaaagctggcggccgtttgggatgaaactaaagatcatttaaaagaaaatgctctttcattttctggaggacagcagcaaagaatctgtattgcaagggttttggcagttcaacccgaaattattttactagatgaaccaaccagtgcgttagacccggtatcttcagcaaaggtagaagatagtttattagcaattaaggatcaattcaccatcgcggtcgtaactcacaatatgcaacaagcatctcgaatttctgatcaaacagcttttttcttggatggcaacttggtggaatttagtaaaacagtcgatatgtttacacatcctgaaaaacaggagacgagcgattacttaaacggtaaatttggataggaggaactagcatgagagggatttttgataatgagttgaggcgcctattaggcaagtttacggagatgggaattaacgttagtgaacagatttaccgtgcgactaaatcgtttattgaccatgatcgagaaatggcgcagagcgtgattgattatgataataacgtcaatgaagaagaaattgctttagaagatcaagctttaaaattgatggccttacaacaacccgtggctgccgattttcggcaggtgattgtcgtcttaaaagctagttcagaactggaacggattggcgatcatgcagtcggaattgccaaagaaactattcgaattaaaggacatcatcgggatgctaaaatcgaagccgaaattgctgaaatgacgaacgttgttcgaacgatgctggatgttacgatggatgcctacgtaaaaagagatagtaaattagcggatgaagtaattaaagccaacgagcagattgataacagctataaaaaaattcgtaatgaagttttgagtaatatgaaaactaaccccaaactagtcactgggggagcagggtatttaatggtggctaactacattgaacgaattggcgatcatgttaccaacgttgtagagtggattttgtataatcagtcaggaaagattaccgaaattaatgcagatgtcgcagatgtgggtggaatcgattagaccacgaaacgagtagttattgctaaattaaaaatttagtaataactactcgtttttttgtataaagtttgctaaacgaaagacaaaagctgtaaaattactattaacaataatgtttagaggtgaagtatttgaatatgaattccaaaacaaaatttgctaaatcaaatgaccgtttgataaccggggttagcggcggaattgccgaatattttggctggagtaaagccctaactcgggtgattatgttgatgttaatgttagtatcacatggacttttgttaatcccatatattattttagcttggttaatgcctagtaaaccaattgaatcaaatcaaggctttgccagcatgttcagtaattatatgggtagtatgaacggtcagtctcaaaataataagaagagaaaagaaattaaaaacgttgaagaacacgacgtcaacgaataaagatgggagaatttaaatgcgcttttggcaacgagtattagttaattgcattctttttgtggctttgaccggatttttccaaagtaatggaaatttctatgtttcaagcatctggattgctttggtggctagtttgattttggcaatattgaatgccagtatcaggcccatcctacaaattatttcattaccaattacattgttaactttaggcttgtttagtattgtgattaacgctctcatgttggaattaacttccgtatttgtaggagcatctaatttttatttttcatcctttgggatgacgatgttgatttcggtaatcttatccatttgtaatactattatttcgaaccactttacaaatcgttagcgaaggaggcccattcaatggccgatggtgtttcagtatctgagttagtagaaaaaataagattagatgtattttatggcgatgaactattagaacaaaaaaaagttacagttagtgatatttcacgtccaggtttagagttaaccaattactttaaattttatcctcatgaacgaattcaactgtttggagaaacagaaatttcgtacgctaaggatagtatgactaaagatgaacgaactaagatttatgatcgaatggcggacgttgatactccagcatttgtggtttcgcgtggtttaccaattcctgaagaattgatccaggccgccaaaaataatcaggttcccatcttaacgtcaactttaccaacctcacgtctgctaagtaacatgaccaactttttagaagatcggttggcagaacgtgattcaattcatggtgaactactggaaatttatggattaggggttttaattacgggagactctgggattggtaaaagtgaaacggcgttggacctaatcaaacgcggacatcgtctgattgcggatgatcgggttgatatttaccaacaagatgaacaaaccttaattggggaagctccccgcattcttcgccatcttttggagattcgaggtgtcggaatcattgatgtaatgaatttatttggggcgagcgcggttaaaaatcacacggaaattagtgtgattgttcatctacaaaattgggataaagatgcgcatttcgatcgtttaggtaacggcgaacaaacacgacatttctttgaattagatattccaaagattaccatcccagttcgtgttggacgaaacctcggtgatattatcgaagccgctactatgaactttagagctaaaaatatgggatatgatgcaaccaaagtttttgatcgtaacttaaatgagttgatcaaagataattcccagaaataggagtggattttgtgaatttaacgttaggagcactaaatccaattgcctttaatcttggtggaattcaagttcattggtatggaattatcattgcgtcagcagtggtgttagcgacgattttggcagttcaagaagctaaaaggcgaagaatcgatccagattctatctacgatttgattttatgggccttaccagtggcgattattaccgctcgaatgtattacgttatttttgagtggggatattaccaaaaccatgtcgatgaaattgtccgcgtttgggacggtggtattgccatttatggggccttgattggggctggaatcgtggtctacctcttctgtcgtgcaaattggattccagtttggttaatgttggatatcatcgctccagtattgattatggcccaaggtattggtcgatggggtaattttatgaatcaagaggctttcggcagaattactagcttaacatttctccaaagtcttcatttgccccattttattattcaacaaatgctgattgatggagcctaccgtcaaccaacttttttatatgaatcgctttgggacatcttgggctttattgtattgatgagtttgagacataaaaaacatttattcaaacaaggggaagtgttcttgtcctatgtaatttggtatgcgtttggtcgcttttttgtcgaagggatgcgcactgatagtttgatgctattaggcatccgcgtgtcacaatggctttcggtaatactttttatcggagcaattggtatattggtgttccgccgtaaatcgatgcgagaacgcctaccagattatttggaaggtaatcagctttcaccaaaatgaacttgagtaaagtacctttgtatacgataatagaaaggtacataaattatttttaaatttaagattgtaaggggattaactatggtaaaaaaagttgcagtgttaggagccggatcatggggcagtattttagctaacatgcttgtccaaaatggcaatgatgtagttgcatggacgaacatggaggaacaagctaaagaacttaacgagcagcactccaatgaacattacgttcccggttttaagtatgacgaacgtttagtagcaacaaccgacttagaagtagcgttgaaggatgttgatgcggtattgtttgttgtaccaaccaaggtaatgcgattagttgcccaacaaatggttgaagttttaaagaaaactggtcaaaagccaattattgttcatgcaagtaaaggtttggaacttggaacgcataagcgtttgtcagaagtattagcggaagaaattcctagtgaattacgtcaagctattgtagttctttcaggtccaagtcatgctgaagaagttgctaagcaagatttaacgcttgttacagcagctagctcagatttagcaagtgctgaagcagttcaaaaattatttatgaataattacttccgcgtatatactaatgacgatattgtcggagttgaaatgggtgccgcacttaaaaatgtaatcgcaattggagccggagcattacatggcttgggttacggtgatgacgctaaggcagctttaatcacacgtggtttagctgaaatttctcgtttaggagtagcctttggggcaaacccactcactttcatcggtttatctggtgtaggtgatttgattgttacggcaactagtgtgcattcacgaaactggcgtgcgggtaacgaacttggccaaggtatgaaactagacgaagttattgatacaatgggaatggtgattgaaggagttccttcaactaaagccgcctgtgaattagctcagcaaaaaaatatcgaaatgccaattactgaagctatctatgatgtattgtataatgaaaagggtgtcaaggaagcaatcgacgaattgatgcatcgtgacggtaggtcagaattagagtaaaaatttttggaggttaggtattcatgaaaaaagtacgtaaagcaattattcctgcagcaggattaggaactagatttttaccagtaaccaaagcttcacctaaggaaatgttaccaattgttgataagccaacaattcaatacattgtggaagaagctcgcaagtctggaatcgaagatatcctaattattacaggtaaaggtaaacgtgctatcgaagatcactttgatgcggttcctgaactagaagaaaacttgaaagctaagggcaagaaggaaatgttgaagatggtggaagaaaccactggcttaaatatgtacttcaaacgtcaaagtcatccacgtggattaggggatgctgtattaactgctaaatcattcgttggcaacgaaccattcgtggttatgcttggtgatgatttaatggaagacaaagttccgttgactaagcaattggtagattcttttgaagaaactggcgcttcaactttagctgttttgccagttcctcatgaagaagtatctaagtatggggttatcgatccttctgaagaagttgaaaaggatttatacaacgtttctaaattcgttgaaaaaccagctgtagatgaagcaccaagtaacttagcaattatcggacgttacgtacttacgccagaaattttcaacattttggaaaaacaaggccttggtgaaggtaatgaagttcaattaaccgatgccattgatacattaaataaaaaacaacgcgtatttgccaaagtatttaatggcgaccgttacgatgtaggtaataagtttggcttcttgaagactaatattgaatatggtttaaaacatcctgaaacaaaagatgaattaaagacctacatcaaagaattagccaaagaacttgaagaaaaataattattgtatttaaaatcaagcgattctgggttgaccggatcgtttgattttttatataaaacaaaatgatagacagttattaaaagtaagtgtatagtgaatgcattattaaaagtgtggaggaaagagaatgacaaaacaatatgatgttgttattattggggccggcccagccggaatgacagcggccttatatgcttcccgtgcaaacctatcggtagtgatgctagatcgtggaatctatggtggtcaaatgaataatactgctgatattgaaaactttcctggctttaaatctgttttaggaccggatttatcaaaagatatgtacgaaagttcaactcagttcggcgctgaatatgcttacggcagtgtcgaatccattcgagatgacggagctactaaactcgtcaaaactgatatgggtgacgagttcgaagctaaagtagttattattggtactggttctgaatataagaaattaggtgtaccaggcgaagaagattttagcggacggggcgtttcgtactgtgcggtctgtgatggagccttttttaaagggacagatgttgtagtggtcggtggcggagactctgctattgaagagggtttatacctaacacaattagcttctaaggttaccgtgattcatcgtcgtgaccaactacgggctcaaaaaattatccaagatcgtgcttttgccaatcctaagatggaatttgtctggaacagtaatgttacagaagtagttggtgaaggtaaggtcacgggcgttaaagttaataataaccaaactggcgaagattcatttattgaagcagccggagtattcatttacgtaggggtaaaacccatgacggccgcctttgcggacttaggtattttggatgaacaaggttggattccaactgatgaccatatgcatactaaggttcctggaattctagctgttggtgatgtacgtaagaaagatttacgtcaaatcacaacggccgtaggtgacggtggcgtcgctggacaacaagcgtatgaatatattcaagctttaaatgattaaagtcaaaataagccacggtgaaaaccggggcttttctttttgccaaaattcaaaaagtgattggtctatagctaaaattaaaaaaacgctttctggtattccatgggtattgtataatgaaagtaactataagttacatcataggaggatttttgaatgagttgggaagattctgtcaaagaatggcaagattatgcagatctagattttaatttaaaaaaagaattagcaactttagctgaagataaagatgctttaaaagaagccttttatgctccaatggaatttggtacagcaggaatgcgtggcgtaatgggccctggtatcaaccggatgaatatctatacggttcgtcaagcaacagaaggtttagctaattttatggataccttggattttaatgataagaaacggggagtggcgatcagttttgattcccgctatcactcacaagagtttgctttagcagcagctggtgttttaggtaagcatggtattccaagttttgtttttgatagtatgcgtcccactccagaattatcatatacagtacgtgagttaaacacttatgctggaatcatgattactgctagtcataatcctaaacaatataatggatataagatttatggtcctgatggcggacaaatgccaccaatggaatctgataagattacagaatatattcgccaagtaactgacatctttggtgttgaagctcttactcaaagtgaattaagagctaagggcttaatgaccattattggtgaagacattgacctcaagtatcttgaggaagttaagacggtatcaattaatcatgaactaatccaacgctttggtgcagacatgaagttgatctactcaccattacatggtactggaaaagtagttggtggacgtgcgttagaaaatgctggttttaaggattacactatggtccctgaacaagcaattgctgacccagaatttattacaacgccattccctaacccagaattcccacaaacttttgatttggctattgaattaggtaaaaagcaagatgctgaccttttgattgccactgatccggatgccgatcgtttgggagctgccgttcgtttaccaaatggtgactacaaattattgacaggaaatcaaattgcagccctgatgttagaatacatcttaactgcgcatgatgcagcaggtgacttgccaagtaatgcagctgccgttaaatcaattgtttctagtgaactagcaaccagaattgccgaagcccatcatgtagaaatgattaacgttctaactgggtttaagtacattgctgaccaaattaaacattacgaagaaaatggcgaccatacctttatgttcggtttcgaagaaagttatggctatcttgttcggccatttgttcgcgataaagatgccatccaaggaattgtcctattggctgaaattgctgcttattatcgtagtaaggggcaaaccttatatgacggtcttcaaaacttatttactacttacggatatcatgaagaaaagaccatttcaaaagatttccctggagttgacggtaaagaaaaaatggctgccattatggaaaaggttcgtgaagaacgcccaagtcaatttgatcagtacaaggtattagaaactgaagacttcttagctcaaactaagtatgaagcagatggatctacccaagctatcaaattaccaaaagcggatgttttgaaatttacattagatgatggtacttggattgcaattcgtccttctggaacagaaccaaaaattaaattctatattggtacagttggtgaagatgaaaaagatgctttgaataagattgatgtttttgaaacagctattaatgaacttataaaataatatttaaagaactatgacggagctcaaattgaatggttatgcgcgattcagttgggcttttggagcatagttcttttttattctaattaagtgaatcggaaatggttttgtgatagtattagtaacaatttaagtaagtttaaggagagattgccatgggaatgcatcaatatttgaagagtttaagtaatttagaaacaatttatcgggcaccaggattttttaaatatcaaaaacactcggttgcagagcattcgtttaaagttgctgaaattgcccaatttttaggtgatattgaagaaaatgctggtaatgaagttaattggcgctcactttatgaaaaatcattaaatcatgattataacgaacgttttattggagatattaaaacccccgttaagtatgcaacaccggatttacgaacgatgttagctaacgtggaagattccatgaaagacaatttcattaaaaatgaaataccagtagaatttcaaggagcttacacgcgtcggctctcagaaggtaaggatgacacattagagggacaaatactttctgtggccgataaaattgatttattatatgaatcatttggtgaaattcaaaagggaaatccggaagatgtttatacggaaatttataaggaaagtttacggacgattgttgaattcaaaacgatggccagcgtggagtatttcttagataatgtcttaccagaccttttgaatgaagagtttactgatcaacttaaattggaacgcattagtcgtgcaattatcgcgtagttaaaaatggcgaaagtatgttcggtgtgataaaatagttatggttaatttcgagtaaatataattttaggaaatggctgagaactgatcctgatcggttcaatctcagtcattttgtgtgaacggaggaaaacgaatgattaaacgtgagaatgatcgtgaatttgaattggtttctaagtaccaaccaacgggggatcagccaacggcgatcaacgaattagttgacggtattaaaagtggcgaaaaagaacaaatcctgttgggtgcaacgggtaccgggaaaacttttacgatttctaacgtaattcaaaaagtgaataaaccaactttaattttgtcacacaataaaactttggcgggccaattatatggcgagtttaaacagtttttcccgaataacgcggtagaatattttgttagttattatgattattatcagcctgaagcatacgtaccatctagtgacacttatattgaaaaagactcatcaatcaatgatgaaatcgatgagctccgtcactccgctactagttcactacttgaacgcaatgatgtgattgtggtggcttctgtttcaagtatctttggtttgggtgatcctcgagaataccaagatcaagccttaacacttcgagtagggcaggagattgatcgaaataagttactacgagaattagttgatattcagtacgaccgtaatgatattgatttccagcgcggccgttttcgggtacatggcgatgtagttgaaatttttccggctgctaatgatgcgcattccattcgagtggaattctttggggatgaaattgatcgaatgcgtgaaatggatgccttaacgggagaaattattggtgatcgagatcatattacaattttcccagcaacccattttatgactaacgaagatcgaatggaacatgcgattaagaacattgaagcggaattgaaggaccgtttggaagaattagatggtgaggggaaactcctagaagcgcaacgtttacgacaaagaacgacctatgatatcgagatgttaaaagaaatgggatacaccaacgggattgaaaattattccagacatatggatggtcgtaaaccaggtgaagcaccttatactttactagatttcttccccgatgattttctattggtcgtagatgaatcccacgtaactatgccacaagtacgcggtatgtacaatggggatcgagctcgtaagcaacaattagtagattacgggtttagattgccaagtgcgttggataaccgaccccttaaattagaagaatttgaaaaacatattaaccaagtggtttatatgtcagctaccccaggtgattatgaaaatgaacggactaataacgtcgttcaacagattattcgaccaactgggttattggatccaatcatcgaaatacgcccaatcatgggacaaatggatgatttgctaggtgaaattaatcaaaggattgaaaaagacgagcgtgtatttgtaacaactttgacgaagaagatggccgaagatttaaccgattatctgaaagatatggggattaaggttgcttacttgcatagtgatattaagacgctggaaagaacccgtattatccgtgatttacgggtaggcaagtatgatgttttagtaggaatcaatttgcttcgtgaaggaattgatgttccggaagtatctttagtagcaattttagatgccgacaaggaaggtttccttcgaaatactcgttcgatgattcaggtggctgggcgtgcggcacgtaatgaaaatggacacgttattatgtatgctgatcatatgactaattccatgcaagaaaccattgatgaaactgcacgacgtcgtacgattcaagaagcatataaccgtgaacatggaattactcctcatacaattaaaaaggatattcgttcgttgatttcatcaaccagtgatactgaggataaaggtaaaaaagacgacttcttggacgttgattttgccgacatggatagtaaggatcaaaaagaaatgattgcaaacttggaagatcaaatgcgagcggctgctaagaagctagacttcgaaaaagcagctaacttgcgagatactgttttagaattaaaagcacagattggttaggaggcctcttttttggcaaatgataaaattgttatccacggtgcacgagcacataatttaaagaatattgatgttaccattccacgcgataaactagtggtggtgacagggttatctggatcaggaaagagttcattggcttttgataccctctatgctgaaggtcaacgacgctacgtagaaagtttgtcagcgtatgctcgtcaatttttagggcaaatggataagccagatgttgattcaattgatggacttagtccggctatttcgattgatcaaaagacaacttctaaaaatcctcgttcaacagtcgggaccgtaaccgaaattaatgattatttaagattattatgggcgcgagttggtcaaccaatctgtcccaatgatggtacaccgattaccagtcagacggtcgaacagatggtgaatcgagttttggatttgccggaacgttccaaggtgcaaatcatctcaccgattgttcgtgctaaaaaaggccaacataaaaaggtttttgaaaaaatcaaacgtgaaggctttgtgcgggtacgagtagatgacgaaaccatggatgttgaagaagtaccagaattggataagaacaaagttcacaccattgatattgtggtcgatcgtgtggtggttaaagacggaattcggtctcgtttatttgattcatttgaagcagctttacgcctcagtaagggttatgctacagcagatgtgattggtggcgaaccaatcttgttctcagaacattattcctgtccggtttgtgggttcacagtgggagaacttgaaccccgactattttcatttaatgccccttttggagcatgtcctgaatgtgatggattaggaattaaattggaagtggatgaagatttagtcattccggatccatctaaggcgttacgtgaaagagcaattgcaccttggaatccgattagttcgcaatactatccaaccttactagaacaagctgctaaaagttttggaattgatatggacactccttttgaggatttacctaaagcagatcgccagctcgttttatatggttctaaaggtaagaaattccatttccactatgaaaatgattttggtggagttcgggatgtggattccgtatttgaaggtgtaatggttaacattgatcgtcgctatcatgaaactaatagtgatttcacgcgagatcaaatgcggttatacatgcgcgaattaacgtgccaaacttgtcatggttaccgtttgaatcgaaaggctttatcagtaaaaattgatggaaagcatattgccgaaatttcagctttacccatcgatagtgccatggaatttttcggtaatttaaacttttcggagcaggatacagctgttgccactccaatcttaaaagaaatcaaggaccgtttgaatttcttacgtaacgtgggattagagtatctaactttgagtcgctcggctcgaacactttcaggtggggaagcccaacgcattcgtttggcgactcaaattggctcgaatttatctggtgtgctatatattttggatgaaccttcaattggtttacatcaaagggataacaatcgattaattagttcccttaaaaagatgcgggatttaggtaacacgctagtagttgttgaacatgatgaagatacgatgtgggctgctgattatcttattgatattggaccaggagctggcgaaaatggcggtgaagtcatggcagctggtactcctaagcaagtggctaaaagtcgtaaatcactgacggggaagtatctatccggaaagaaatttattccagttccagaaactaggcgtacaggtaatggtcaatctattaaattaaaaggggtacaagaaaataaccttaaaaatattgatgttgacttcccattaggtgaatttgtcgctgtaacgggagtttctggctcaggtaaatctacgctagtcaatatggttttaaaacgagttttggctcaaaaattaaaccataattctgaaaaaccaggtaaatataaatcggttagtggtattaaaaatattgaaaaagttatcgatattgaccaatctccaattggccggaccccacgaagtaatccggcaacttatacgagcgttttcgatgatataagaggcttatttgctcagactaatgaagctaaactccgaggatatacgaagggtcgttttagttttaacgtcaagggtggacgctgtgaagcatgtaagggtgacggaattctaaaaattgagatgaatttcttgccagatgtttacgttccttgtgaggtctgtcatggaacacgttataactcagaaacacttgaagttaagtacaaaggcaagacaattgctgatatcttggatatgacggtggaagaagcaacagatttctttgctcccatccctaagattgctcgtaaacttcaaaccattattgatgtaggattgggctacgtacatttaggacaatcagctactaccctatctggtggtgaagcgcaacgtatgaagttagcttccgaactacacaaaaaagcgaatggtaagaacttctatatcctagatgaaccaactactggtttgcatacagacgacatcagacgtttgttagatgtattacaacgtttggtagataatggtaatactgttttagtaatcgaacataatttagatgtaattaaaactgccgatcacttgattgatctgggtcctgaagggggcgctggtggtggacaagtggtggctgttggtacaccagaagccattgctgcggtacctgaaagctatactggtaaatatttgaaagaagctctagagcgtgctcaagaacttagtcagaaataatacaaaaggggcaatttgtgctcctttttatataacttaaaaaagacacgcccggatgtgttatactggagtagctacctttataggaggaattaataatgaatgaacgactacaatttgttgtggtaacaggaatgagcggggctggtaaaacagtcgcaatgcaaagctttgaagatttaggatttttctgtgtggataatatgccacctgctttattaccaaagttttgggaattaattaaagaaaatggaaaaattagcaaagtagcgttagtcgtagatttaagatcacgaggtttttatgatcaaatcttagggttacttactggtgaagaagaacaacataatattaaaacggacgttgtattcttagatgcgacggatgaagaactggttgctcgctataaggaaactcgtcgcgctcatccgttagcaatggatggacgggtagctgatggcgttcgtaaagaacgcgagcttttatcaccgattaaatcagaagcacaaattgttattgatacaactaatatgacacctcgtgagttacgaagtgatatttttggacacttctcaacgaataagacgattcctaagttccacattgaagttgtttcatttggctataaatatggtagtccaattgatgccgatatcattatggatgtccgctttttacctaatccatactatgttactgaattaaaaaataaaattggaacggatccagcagtttatgactatgtcatgaatcaaccggctaccgaagaattttatacggattacttaaaattattgatggatattatgccagggtatcaaaaggaaggtaaatctaacttaacgattgccatcggctgtactggtggtcaacatcgttcagttgctattgcagaacgtttggcaaaagatttatctaaaaaatatgtcacaaatatatcgcatcgagatgcgcataaacgaaaggaaacggtaaatcgatcatgaccagaaaaaaaggtcctaaaattgtcgtaattggtggcggcacgggactaccagttatccttaaagaattacaccaacgcaatgctgaaattactgcgattgtaacggtcgcagatgacggtggttcatcgggtatcatccgagattatgttaacgtagttccgccaggggatattcgaaatgtaatggtcgctttatctgacattgcccctgaatttaaagatatttttcaatatcgctttagaagtcaagataagtttcttgccggacatgctattggtaatttgattattgcggcgctttccgaaatgcgtggtgggattgatccagccattcgagaattatcagaaatgcttcaagttgagggccatgtttatcctgccagtgcacaacctttagtgttacatgctaaatttacggatggcacgctgttagcaggggaagctgaaatcacagcggctcataaagacattaaagaagtgtgggtgggtaacaatccatggagcgaaactaagaaaccccatgctgtaccggaagcactgcaggcgattgaagaagccgatgaaattattttagggcccggtagtctatttaccagtatcttgcccaacttaatgattgaagatattggacgcgctgtacttaaagcgaaagctgaaattgtttatatttgtaatattatgactcaaaagggtgaaactattaattttacagatgcggaacatgtacgaacattgaatcgacacttaggacaaaactttgtcgataccgtactcgttaataccgaaatcgtgccagaatcctacatggatttcaatcgctatgatgaagtttccaaacaagtagttcatgattttaagggattacgggaacagggtgcacgagtaatatcggacaatttcttattgttgagagatggtggagcgttccatgatgggcagaaagttgtagacgaattgatgaatgtttgtagcaaccccatcaagaagcgtgattaggaggttcagaatttgtcatacgcaagtgaagtaaaaaaagaactgacaagtttggaagttcacgaaaaaaatgctaaggcggaattgatggcgttaatccgaatgaacggtgcaattggtatcaataatcgtcagcttacattaaatacacaaactgaaaatccagccattgctagaagaatttattctttacttaaagaattttatcatttggaagcagaacttagtgttcgacggaagatgaaattgaagaagaataacttgtatatcgttcgtttacgcacgggcgttaaggagttattgaatgatttatcgattttaaaagatgattttcagattaacgaaaaagttccggaaggtttgttgaccgaagaatcagaattacggtcctatctacgaggagcctttctagctagtggatcggtaaataatccagaaactagccgttatcatttggaaatttattccctttatgaatcacacaaccaaatgattgctgattggattaataagtataatttgaatgctagaacgactgagcggcgtagtgggtatattgtttatttgaaggaagcagaacatattgctgattttctacaattaatcggagcaactaattcgatgctcaaatttgaagatgttcgaattatgcgtgatatgcggaattcggttaaccgtttggtcaactgtgagacggctaatttaaataaagttgctaatgcatcgatgaaacagattaacaacatccaatttattgatgaaacagtcggattaggcgaattaccacctaaattgcgtgaagttgctgaggctcgtttgattcatcgagaagttagtctcaaagaattgggtgaattagtacccggtggtccaatatctaaatcgggtattaaccatcgcctgagaaaaattaatcaatacgctgagaagctaagagcttaattaaatcaagaggatatcttcagaaatacttgaaggtgtcctcttttttacacagtgtatattgtaagggcttaatgtaattgtaatgtaaaaaattggaacaaattattatgctaatattgactacgatagatgaatgtcaactaggtaaacaaactaaaggggaatacgagtttatgaattctaaattacattacaaaatgtttaaagcgggtaaaaagtgggcctttgcaagtatcgcagctgccagtttagggatcattgctttagatgctaatgcaactaatgttcatgccgatagcaccgacaatgatgctactgatacggttgatggtagtacgactacttcacccgtaagcgaagcaagtgttacattaacgaagacttctttaccagctagttcagcagctagtgctagtgtggctagctcagcaacttcagcagttacaagtactgctacttccagtgctgtaagtaaatctgcaactaattcggtggtgacttcgagttcggctaagagtgcgacaagttcatctgctacatcaactgcaagctctagtgcaaagaaatcagttgctagttcagcggcttcatccgctagtgaaaaaaccgtttcaagcactgctaagagcgttgctaatagctcaagtgtagttaaaaatacaagttctagttctactaaaaactcaagtgcagctgtttcagtagttgcgcattcaaattcaagtgccgcttcttcgacagccagctccaaagctgctattaaaacgagctcagctgctagtgtaagttcaagtgcggtctctaaaacaagtagtgctgctactacttctaaaaataaggcggtagataagaaatcaacttcaaaggactatacgattgattatacgcatcaattaagtgatgacgagggtagtgatcagcaaactaaaaataacgtaatcattgcacacgccactggagtttatgcaccagctgaaaatgtagctatttttgaaaaacgtgaatgggacagcagcgaaagctatgttcaatatatcgttggtgatggtgggaaagtttatgcagttggacaagaaggatacgtcgcttggggcgcaggcgaatgggctaatgaaaatgctcctgttcaagttgagttagcacaaacatattctgatagccaatttaaaaaagattatcaaacttacgttaacctactaagggattctgctaagaaatggaatattccaaccagtctagacagtagtgaatatcgtggtattaaatctcatgtatggattactaatcatgtttggggaaaccatgtagacccttacggatatctttcgacccatggtatttcacaaactcaatttgcccatgatcttcaatatggatttggtagtagcagtagtgattcaagtaataatacatctaatgatagcgacaaaaataatgctaacaacagtaataaaaatgattcaaatagtaataaaaataattcaagcaagataaatattggcgataaagtaaccatcaagacaagtgctaagcattgggcaactggacaaacaatctatagtgccgttaagggtaagacttacaaggttatgcaaattaatggtaacaaattgctcttggacaaggttatcagttggattaacaagggtgacgttacggtgccagggtcttcatcatcaaatcaatccagttctaacaaaggtaacagtagtaatggtaataaaaataacagcagcaataagattggtgtaggttccaaagtaaccatcaataagaatgctaagcattgggcaacgggtcaatctatttacaatccagttaagggcaagacttacaaagttatccaggttaacggtagtaaattgcttttagacaaagttattagttggattaataaggcggatgtaacattagctggctcaaaatccaattcaggttcatcaaacaagaataacgcggcttccatgcataatgtgaatgttcatttaactaacaaacattggacaactgcacaaactaattttgtaaatggtattgcagcagatattgttaatgtatgtaatagcaataagctctatgcttccgtagctatggctcaagcagttttggaaagcgggtatggaacttcatcacttgctcaagaagcgcacaatttatttgggattaaggctgatagcacttggaaaggtgctacctatactaagagtactaaagaggttatcaatggtcgcacagttaccatcaatgcctcatttagaaaatatgcttctatcaaggattcaattgcagattacgctaagaaacttgaatcacgtgcacaatacgctaatgcatttgcaccaaaatcagctaactatgtggcttctattaaagctatcaaggctggtggttacgcaacttcaaccacttatgttggtagtataattaactgcatcaatagtaatggtttctttaaattagacggattaagcaaagcccttcatctttaagatttaattaggttaaaataggagactggaacatacaatctgtgttacagtctttttattatatggggaaaggatgaatggaagatgaaatattcagagtttcaatttgtacaactttgggatggaagattggggactattactaaagttttgccaagtggttatcttattgaagataattattgggattggttagcaagtaaaaatgaggaagatcctgaaaaatacatctatccgcatgctgacattgaaaagaatttctcagccctcgaagaggaaattgaaggcgaagcacaaattgccgaagaaattttcgaatttcgttacaaaatgatgaaaagtgcactaggaaaataaaaaaagacatcggaatttttccgatgtcttttttatgccactaattattttaagttagcatttttttccatgataccatcaatcaaaccgtattcaacggcgtcttgagctgatagatagttatcacgttcagtatcaatattaatcttttcaagaggttgtccagaattttcagctaaaatcgtattcaattctttacgagtcttcaagatttgttctgcagcaatctcaatttcagtttgttgaccttgagctccaccagaaggttgatggatcataacttctgaatgaggtagagcaaaacgtttaccctttgtaccagatgaagcaagcacactggccattgaagcagccattcccattacgattgtttgaacatcagatttaatgaagttcatggtatcgtaaatagctaaaccggcggtaacaactccaccaggagagttgatgtataggtaaatatccttttctgagtcttgtgcatcaaggaagagtagttgagagatgattgagtttgctaaatcatcgtcaataggacctgatagcatgatgattcgatcttttaatagtcgtgagtaaatatcataagcacgttcaccacgtgatgattgttcaataactgttgggaccaagttcataacttagtaacctcctttattatcgtaaaaaatttcctgttaaataactaacatggctatagtttatatcattggtcaaaaaaggtcaaatatttttgctctttaaaataaaaaacaacctagccggagaaaattttcgaccagattgcatatattgtctaatgtaccaggagacaatggttgtagctattgaataaatagtagtatataatgcagttgtaagcgaatttatgcataaattcgctaagtaatgcgccatgagggagtcgaaccctcagcttgagaaccggaatctcacgtgctatccattacactaacggcgcctaacaatttgattttacagtaggacagaagaaaaaacaagataattgcggagaattactatggcaataaaacaaggatttagtcaaaatcaaactcaacaacaaaatcaaatccaacgtttagcgatgacgcagaccctacaacagtcgattcagatgctgcaatataacgttgaagagcttcaaaattttctcaaacaaaaagaaatggataatccacttattacggttgaaatggctgctgaaaagccaactagtaagatttcaggtgattccgatcgacacgaggcatttatgaatcaaattgctagtgatacggaacaatcgctatttgactacttattagaccaggttcatttaactatgcgagatacaccattaagacgcctagtattgttgcttttagactatgttgacgataatgggtatttaggaatatccaatgaagcagtgattaaaaagaccggtgcagatgaaattgctgtgatcgatgcggtaactttactccaacagttggatccacctggagtgggggctcgctcgctccaagagtgtctaatgctacaaactgaaaatgatacattttctccagaacaagcttatttgattttggaagaatcttttgaagatttagtcaatcgtcaatgggataaaatcgctaaaaaatatgatattcaattgagtgatgtccaagcggtttttgattacgtcagaacattaacacctaaccccggagcaggatttggaaaacaagagcatagttacattatcccagatttaatctttagcattgaaaatgatgaacctcaattactacagtctaaggcttcacgtcctaaagtcagcttctcacaacattattttgaacaacttcaaaacgttgatgaagaggtcaaagcttatgtcacggagaagaagaaagaatacgactggatttcgaaaagtttaagtcaacgggaagataccattctcagagttggaaagattatctttgaaaagcaaagtgaattctttatgaatcaaagtaaagagctaaaaccgttgcttctaagagatgtcgcgaataaattacatttacatgaatcaacaatatctcgtgctgttaacggtaaatatattgcaaccccatttggtacgtttgaactgaaatcgttctttagtaatgctgttaatcgtgaaagtgatgtttcagcagatgcagcaaaagaaaagattaaaaaaattatcgatgaagaggataaaagaaaacctatttctgattcgaaaattgagaaaaatttaaaagaaagtgggattgcgatttcgcggagaaccgtcgccaaataccgcgaagccattgggattccatcttcttcaaaacgcaagcgatttgattaatttaaaaagccccaaataagttgagtttaaatttgcaaaaaagatgggggcttgttataatttaattcgtaagtgaggtatacaacaaaagttaattcttgagtttgtgtgccatttatttttaatttgttgggtcgttttgtggcactgctggacaaaacaagtcccacaacaggagataacatggatgataatgagatggatttattagaatctgttgttccaggtttgattggtgaatttctacagagatttgatatcttaaaatcaatcgatctgcttgctccggttgggagaagagttttatcggaacatctacatctcagcgaacgcgtgctaagatcacaaactgatgtgttaaaaacacaaggattgttgacgagttcgcaggctggaatgatgctttctgatgagggccggcgcgttatgaatggtctcgaacctgtagctaaccgattcttaggcttaactagccaagaaaagctattggcggaacgtttggacatcgaaagatgttttatcgttcggggagatcgtgctgacggagatgcggtcacaaaacaactcggaacaattttaaatgatgcacttgcaaaattgttgccagagggtaataatactatagtggtaatgggcggttcaaccatggcatcggttgccatgcagttgtcgtcagagctttcgaacaatcgaaagctaacctttgtaccgggtcgtggtggaattggtgaatcagttgataaacaagctaattcagttgcggcgttgatggctaagcgcactagaggtgaagccaagtcattatacatcccggaacaattgagtgagagcacttaccacccccttttaaatgaaccgactgtaaaacctgtgttggatttaattagtcacgcaggagttgctatccatggtattggtaaagctggcgatatggccagacgtcgaggagttaacgaagaaatcctaagttaccttcgaaaagccaaggctgtgggggaagcgtttggatctttctataatcgagaaggacgcatcctatatcaagttcatcgaattgggttacagctgaatgatgttcagcatttcaatcatgtattcgccgtggctagtggtcatgacaaggctcaggctattgagtcgtacatgaaaatcgcaccgcatcagacaattttaattactgatgaaggtgcagcaaacgcgattttaaaaaagtaaagccattgtgacttaactttttaaaataaattatttttttagattcctaaaggaggaaatcttacttatgactgtaaagattggtattaatggttttggccgtattggtcgtttagcattccgtcgtatccacgaattgggtgcaaaatcaaatgacatcgaagttgttgctatcaacgatttgacaagtcctgctttattagcacacttgcttaaatatgattcaacacatggaacttttgctggtgaagttagtgcaactgataactcaattatcgttgacggcaaagaataccgtgtatacgctgaaccaaaggctcaagatattccttgggttaaggaagacggtgttgacttcgtacttgaatgtacaggtttctacacatcaaaagaaaaatcacaagctcatttagatgctggtgcaaaacgtgtattggtttcagcacctgctggctcagatcttaagactgttgtttacaacgtaaacgatgatgttttaactgctgacgaccgtatcgtttcagctggttcatgtacaactaactgtcttgcaccaatggcttacttcttaaacgaagaattcggcgtacaaattggtacaatgacaacagttcatgcttacacaagtacacaaatgcttcttgacggacctgttcgtggtggaaacttccgtgctgcacgcgctgctgctgcaaacacaattcctcactcgactggtgctgctaaggctatcggtcttgttatcccagaattgaacggtaagttacaaggacatgcacaacgtgttagcgttgttgacggttcattgacagaacttgtttcaatccttgacaaggacgttacagttgaagaagttaatgctgctattaagaagcatacagaaggtaacgaatcattcggttggaacgaagacgaagttgtatcaagtgacatcattggcacaacatacggctcaatctttgacccaacacaaacagaagttactaaagctggcgacaagcaattagttaagactgttgcttggtacgacaacgaatacggcttcacttgccaaatggtacgtactttattgaaatttgctactctttaagattaattcttaaaaattgtagatttcaaaccgtctaatcggtctagggacggagggaggtcacttcctccgtccctttttttagaaaaaataatttattaatgatttaggaggaaattctcttggctaaattaactgtttcagatttagatgttaagaacaagaaagttttgatgcgcgttgactttaacgtgccagttaaaaatggtgtgattggtgatgacaaccgtgtcgttgctgctcttccaacaattaaatacattatcgaaaacggtggaaaggcaattcttttctctcacttaggtcgtatcaagactgaagaagacaaaaaagaattgactcttcgtccagttgctcaacgcctttcagatcttcttggcaaaccagttacatttgttcctgtaacacgcggtgcacaacttgaagatgctgttaatggcatgaacgacggcgatgtattattgttcgaaaacacacgttttgaagacttagatggcaagaaggaaagtaaaaacgatcctgaacttggcaaatactgggcatcacttggcgacatgttcgtaaacgatgctttcggtacagctcaccgtgcccacgcttcaaacgttggtgttgctgaagcaatgaaggctgacggcaagcaagttgctgctggtttccttatggaaaaagaaatcaagttcttgggtgaagctgttgacgaacctaagcatccatttgttgctattttaggtggcgcaaaggtttctgacaagattggtgtaattgatcacttacttaataaagctgacaaagttattattggtggtggtatgacatacacattctacgctgctaaaggcatgagcattggtaactcacttgttgaagctgacaagattgatgttgctaaagaaatccttgctaagggtggcgacaagattgtccttccttcagacagtatcgttgctgaaaaatttgataacgatgttcctaacaaagttgtcgaaggcgatattcctgatggttacatggctcttgatattggacctaagtcagttgcagaatttaaggatgtccttaaagatgctaagactgttgtatggaacggaccaatgggtgtattcgaaatgagcaactacgctaacggtacacttgaagttggtaagttcttaggtacattatcagacgctacaacaattgttggtggtggtgactcaactgctgctgttaagcaattaggcgttggcgaccaattgacacatatctcaactggtggtggagcttcacttgaataccttgaaggtaaagaacttcctggtatcgctgctatttcaaacaaataattaaagttgtagaaatcgaagaatcagttgattcttcttttctgctacataacctgtaattcggaaaggatgttttattttgcgtactccaattattgctggaaactggaaaatgaacaaaaacccccaagaaactcaagaattcttggatgctatcaaaggtaagttacctgatgcttctgaagtagaatcagttattgctgctcctgctatcgatttaagcactttagtagctttctcaaaagatgaacaactaaagactgctgctgaaaacagctacttcgaagacgaaggtgctttcactggcgaaacaagtcctaaggctttaaacgaaatgggcgttaactatgttgttatcggtcattcagaacgtcgtcaatacttcggtgaaactgacgaagatattaacaagaaggctaaggcaatcttcaacaacaacatgacaccaatcatttgctgtggagaaactcttgaacaacgtgaagctggcgaaactaacgaatgggttgctggtcaaatcacaaacgctcttaaagatttaactgcagaacaagttgctgcatcagtgatcgcttacgaaccaatctgggctatcggtactggtaagacagcttcaagtgatcaagctcaagaagtttgtcacgtaattcgtgaaacagttgctaagctttacgatcaaactgttgctgacaaagtacgtattcaatacggtggtagtgtaaaacctgctaacattgctgaattaatgggcaaagaagatattgatggtggacttgttggtggagcatcacttgatccagaatcattcctagaattagttacctataagggttaatataattaaggaaatataatataataatagttgaactgcgttaagcagatttaaaaatgtgaggagatatttaaaatgtcacttattactgatatttacgcacgcgaagtcctagactcacgtggtaacccaactgttgaagttgaagtttatactgaagatggtggtttcggtcgcggaatcgttccttctggtgcttcaactggtgaacacgaagctgttgaacttcgtgatggcgacaagaaccgtttctcaggaaaaggtgtagaaaaggctgttgctaacgttaatggtcctattgctaaagaaatcgttggttttgaagttacagaccaaatcgctatcgataaggcaatgattaaattagacggtactcctaacaagggtaagcttggtgctaacgctatcttaggtgtatcacttgctgttgctcgtgcagctgcagatgaactacaagttcctctatacaactacattggcggttcaaacgctcatgttcttccaacaccaatgatgaacgttatcaatggtggagctcactcagaaaacaaagtggacttccaagaattcatgatcatgcctgttggtgctccttctgttaaagaagctatccgtatgggttcagaaactttccatgctttgaagagtcttttgtcagctgatggcaaagctacttcagttggtgatgaaggtggatttgctcctgactttgctaacaatgaagaacctcttcaatacctaatcaaggctattgaaaaggctggttacaaaccaggtaaggacgttgctattgcagttgacgttgctgcttcagaactttggaacgacgaagacaagaagtacaagcttcgctggtcaactggtgaagaattcactactgaagaattcgttaagtaccttgaaggcttagtaaacaaatacccaatcatttctatcgaagatcctatcgatgaaaacaactgggacgactgggcaagcatcactaaagaacttggcaagaaagttcaacttgttggtgacgacttcttcgttacaaacacagaataccttgctaaaggtatcaagatgggtgctgctaacgcaatccttatcaaggttaaccaaatcggtactcttacagaaacaatggaatctatcgaaatggctaaagaagctggttacacagctatcgtttctcaccgttcaggtgaaacagaagacacaacaatcgctgacttagttgttgctacaaatgcaggtcaaattaagactggttcaatgagtcgtacagaccgtattgctaagtacaaccaattaatgcgtattgaagaccaacttgaaggcgttgcagaatacaagggtattaactcattctacaacctaagtgctgacgctcgcgaagaaatcagcaacaagtaattaaattaggtcaatcaaagaggcggacattttgtccgcctctttttttgttattgaattggaattcaggctcaaatatgttaaattagtactagaacttattaagaacatgaaggaggtcatcttgtgtattcacttctgatgacaattctattgattctgtcagtgtttataatcattgcggttatgatgcaaccggctaagactgacagcgcgatgtcttcattaacgggtggtgctggtgacctatttgcaaagcaaaaaccacgtggatttgaagcatttatgcaaaaagtaactgcagtcttgcttttcttgttttttgctgtcaccattgcaatggtttacgtatctgcacactagagagatcgtattgaacaaaaaaattgcatttagcaaattctgaaatttagatttcggaatcattaggaacggctaaagacgaaattagttttgtctttagcttttttatttaataaatacaaaaatatgaggtaagaaatggaaataaacaaattacaagctttaattattaattatctgcaacaacgaccaacccaaaagttaactgctgaggaactttttaagggtttaaatttagaaggggccagcgtgtttaacaccttagtcaaggaattggcattaatggaacgttctaaaaaagttgaaataacggaagatggcaaatttaaaattgctcgccctaaaaatcaattattagttcatggtgtgttccatgctaatgatcgtggtttcggatttgtttcagtagaagaggatgaaattcctgacatttatattagtgaagatcatacagcgtatgctttaaatatggatgaagttgatgtaaaaattactcgtccatctaagaagggtgatgatcgtggtccagaaggaattgttaagaaaattacaagtcgccactttacccaagcggtgggggtttttgaatttgctcctgaaccagagaagaatgttttaggtcatatcaatttgaaagacaagaaaatgtcttcatatcaattcgatgttctagaaggcggaattcaaccaactgacggttcagtgatcacggcacaagttgcgcaatatcctaagcctaattctcctaagttaattgccggggttgctgaaaagacggttggtcataaggatgatccaggagtggacatcttagaagtggtttatcaacatgagttaccaactgaatttccagatgatgtcaaagcagagattgcttcgattccagactatgtaacagatgcagagaaaaaaggacgcgttgatttaactaatgaagtagtggtcacaatcgatggggatgattccaaagattttgatgatgctgtaggtcttaaaaaactagataatggaaattaccatttattagttaacattgcggatgtttctcactatgttaaagaaggttctcctttagataaagaagcatatcgtcgaagtacaagtgtttacttgactgaccgagtaattccaatgttgccacgtaagctttctaacggaatttgttcattaaaccctaatgttgaacggctttcgatgacttgtgaaatggaaattacgcctgaaggagacgtagttaaccataagatttacccaagtgtaattgaatcagatgctcgaatgacatataacgatgttaataagattttggaatctaaagacgaaaaaactatggcacgttatgcaaaattagtgcctatgtttgaaatgatgggcgaacttcacaaaatcttgcttaagaagcgtaagcaacgtggagcaattgaatttagcgataaagaagcccaaatcatcgttgatgaaaccggacatccaattgacattaaattacggacgcgtgggacttcagaacgtatgattgaatcattcatgttggcagctaatgaaacggttgctgagcactactataaggctcatgtgccattcttatatcgtattcatgaaactcccgatagcgaaagaatgttaaccttctttgaattcctatctgtatttggacacgtagttaaaggaagcaccaaggatctgaagcctaagatgctgcaaagcgtgcttaagaagattgctgggactccagaagaagcaatgatttcagtaatgatgcttcgtagtatgcgccaagctaagtatgatgctcaatcattaggtcattttggattggctgctgagtattatacgcatttcacttcaccaattcgccgttatccggacttatttgtgcaccgcttaattcgtcattatgccgaaaatggtactggtgaagcagcacaagcgaaatatgttgaaagcattccagaaattgccgatcatacttccaagttagaacgtcgagcaatcgacacagaacgtgatgttgatggaatgaagaaggctgaatttatggctgaccatgtgggagaagaattccatgcggtagttagttcagtaatgaagtttggtttattcgttgaactggaaaatacggttgaaggactaattcatattagtaccatgaaggatgactactatgaatatgttgaaaaacagatggccttggttggacggaatacccaccgtaccttccaaattggtcaagaagttgagattaaattaatgcgagtggataaggatcaatccgaagttgattttgaattattgcatccagaaaaaacacctaagagtgatattcaacttccaccgcgtcaacaatttaaccgtggtccgcgtcgtaatggtcaaaagcctagtggaaagaacaacaataaatcaggaaatcgaaacggaaaaccattttacaaagataaaacggtcaagaagttttctaaaaatacttctcataagaaataagaggaggttatgttatggctaagaaaccaaagtccaatgataaagcacttgcccaaaataaaaaggcgcgtcatgattattccatattaagtacgatggaagcgggaatggttttaacggggacggaaattaaatccatcagagatcggcgagtaacgttaagagatggatatgtacagatccggcacggagaggccatcctcatgaacgttcaaattaatgaatatttacaaggaaaccaatttaaccatgatcctttccgtaaccgaaaacttttattgcataaaaaagaaattttgaagttacaagaagaaaccaaaaataagggaatcaccatcgtaccgttgaagatgtatctaaaaaatggttttgccaaagtcctaatcggagttgccaaaggtaaacacgaatacgataaacgtgaatcattaaagaagcgtgatcaacaacgggaaatcgatcgagccttaaagaatagataaaaagagattatccgctggataatctcttttttgttagatggattttttcaaatgttgataattatggtgagatacaacttgttcatgatcatttttgaagcctaaacgacgatataaacgttcagcattaggatttaaatcatcgactagtaaacctaattttttaagaccacgtttttgagcatattcaggtagagcattcagtagttgagttccaattcccatgttttggaacttgggattgactaccaatgaatctaggtaccattcgtcggtatccgcttctggatcttcgtaaattggttgggctggtagctttacttgatcaaagtgtttttggaactcttcatctaagatatcttcatgggcccctgggtagccataagccacgccagctacttcatcatgttcatttttagcaacaatgacgtctgcatgttctgcataagttggactcttaaaggtttcaataaagagcttggtaacctcgtttgcatcattatttaagtaaaatggtagttccatttcatctaagataatcttgagtaattcaatcaccgctggaatgtcggcagtggaagctttggttattttcatgtaaattctcctttaaaaaattgttataactggttgcgtcggaattgattttccaagtccgaactaatttaggttcgcgtagcggaggacgcttttgaatccatcgatctaaaatagccgctaagcaaataaagaggggaagatgttcctggtcaaaaacattcaattcaatataggcactaccattgatttgaactcggttaatttctagaatagttgaaattccgtggaaaactttaaaatgacaggttacagtatctccagcaatccaccaatgtaagttgtgaactaaaagaaatccacggataagaccgatgggagtggtaacagttcctaccttggtaccttgcaaaaagagttcaaatttaggcagtttaccaactgatacctgctttagttctgaaaccaattttccgtttaaatcataaaccgagagagcgtcatttttaatgccccatttaccgaccaaaagatatttggagttgtgcttttcatcgctgacaatggtagctcccttattttcgagtccttggctttttagataaaatctacgcatagcatagcctcgttttactgatggttttcatcaagttgctcaagaatggctttagcaaccccattttcattattagtaacggtcagatgattagcaagttttttaatttccggaatcgcattacccatggcgtaactaacaccagcgatttttaacatagaagcatcattcatattatcaccaatggtcattacttgtgacatgggaacgttcaattcatcagcaaagtgttgaaccgcaattcctttttgggcacggggattattgatttcgatgttattttcaaaagaagatgaaatggcaacatcgactttagcatgtaaagcttcacgaacgggttgcaaccccttttgtccattttcaccaaaagccacaagtttaagtacttgaatcttcggatcgtcaattaaaacttggtaatcatccacgtagcgaatgttcattagttccacccgtgctgatgacatagcgactgctaatttgaaaggtgtgtctgggttaaccgtttcaagcaaatgagctacggtttgaattcgacgagtgcgactattagaaacgacgccttggttagttgtaatttcatagtaaagtccggctttttctagttgatgcatgatcaagacggctgatggcttagtaatgggaaccatatctaaagctttaccatcgacgtcgaaaacagcggctccgtttaaagtaattagtgggaccgatagtccgtatgcttcaagcaaaggtttggcttcacgatattcacgaccagtggccactgcaaaatgaaccccagcagcttgggcctttttaatagcatctgcgttggtacttgaaatctgcatttcttcgttaagaagtgttccatccatatctgaagcgataattgaaatcatttataagcacatccaatccatgtatttatgttaattctaacatgacatagctttttttttactaaatcagttagaatagaagtaataaaattgtattaaggagttacgaaatgaaaaaaataatccataacgattggcaagatgttttacaaggtgaattcgaacaagcatattatgctaaattgcatgagtttttgaaacatgaatatgctactcaaaatattcatcctgacatgtaccatatttttcaagcctttgaatggactcctttttcaaaagtaaaggtggtaatcttggggcaagatccatatcatggacaaaatcaagcgcacggactgagtttttcagtgcaacctggggtgcaaattccaccatcgttacaaaatatctacaaagaactccaaagtgatttgggaattgttccagtccaacacggttatctaaaaaagtgggcagaccaaggagtgctacttttgaattctgtgttgaccgttcgtgacggacaagcttattcccatcaagggcatggttgggaacggttgactgacacggcgattcaggccttatcggaaagagagcagcccgttgtgtttattttatggggaaaagcggcccgcgacaagattaagttaattgatcaatcccgcaatattattattcaatcagcccatcccagtcccttatcggcataccggggcttctttggttcaaagccattttcaaaaaccaacgaagcacttgaagcgatgggagagacaccaattgactggcagttgccaacggaagttttggaggaaaaataatcatggaaacctatcaactaaatgacgaagccgaaacgattaaatttggcaaaattatcggggaattactggaagctaacgacgtggtcttattagatggtgatttaggagccggaaaaacgacactgacaaaaggcattgctcaagcacttggaattcggcgctacgtgaagagtcccacctataccattgtgcatgagtaccatgatggtaatatgccattatttcatatcgatgcatatcgtcttgaagaagacggtgcgggagatattggaattgacgaatactttgaaagtgatggagtgaccgtggtggaatggtcacagtatattaaatcgtatttgccagatcaatttttaagggttattttagatcgcaatcataacaataccaaacgttttctaactttggagcctaacggtgaacattatcaaaaaatcgaagaagcaattgaggaaaatatcaatggccgatgaagttagttttgttgaggggcaagctgaggatgcacaagggattgttcaactaattcaaaaattggaatctgaaacaacttccattgaatttgatgatgcaatttctaagttaagtctagaacaaattggtgaaaatctaaatttgatccaacaaagcccattgaattttcttttaattgctaagttgggggagacgccgattggcattgtgaccctaatcgaaactgatgaagtgaagcatcgggctgaattaggcgttggtgtcttaaaagactactggcataacgggattgggacaatgttagtcgatgaagctttatactgggcgaagcaatttagctggttagagcaagtttggctagcagttttggataataatcagtatgctattcaaatttaccaaaacctaggttttcaaactaaaacgcccccaaccatggatggtcaggggcgtcaaattataaaaatggaattatcccttacttaatctgacgaataaaactagctaaggcatcggctccaaattgatgttcttgatgtaataagatattcgcacaggcacggctatcatccagtgcattatgatggtgctgcaaatcaattccaagattatcacaaatcgtattaagtttatgattggtgtaatctggatagaagcttttggaagttcgtaaagtatctagtgtttgatatggtagtcgattaatttgataacgttctaaagtttttttaaggacactattatcaaaagttgcattgtgggccacaaccagtttgtcgggtgtaaagaactgtttaacgacgggccagagttctggaaatgtgggtgcatcactcacatcggcttgatgaatgccatgaacttggacattgcgccaattaaattcagtttcagggttaattaatgagtaaagttcgtctgtaatgacatcattttgaacaacagtcagtgcaattgaacaggcgcttgcacgagtaggagctgctgtttcaaagtccattgcaataaagttcaattgaatcactttcctttattgatttaacctatagtttaacgaataaaagtgagcgagtaaaggagctaatgtaagatgattaaagttggagtgatcggattaggaaatattgctcaaaaagcctatttaccggtgtatagtgagttgcaagatcgttttgaatggcatttaagtagtcgtaatgcggagaaattggctcatattcaaaaacaatttggattccaatatggatcaactaattcagatgagctaataacagagggagtagaagcagtctttgtgcacacaccaactgctacccactatgccattattaagaaatttttggaaaataaaattaatgtctttgtggataaaccagtatcagaaaatatagatgaagttcgagaattgtatcgtctcgctgaaaaacaaggagttttattaacctgtggatttaatcgccggtttgtgccttttcatcaacaattagctcaattaccagcgaagcatttagttacggtaactaaaactcgtgaattagagcagcaaaatccgttatttgcaatttatgacttaatgattcacgtaatcgataccacgcaattcttaatgggttcaggaaaggtagaatttgtcgacggtcaactgatccaacacgacggtaatttgattttagcgcgaattaatcttcgcaagggagatatgttaggaacagcaatgattgatatgcaaacccaaactaatagcgagatggcccaagtggttagtcaaagagggatttccactgtggataacttaagttccttaacgcttcaaaaagaggggattaaacattatcaacaggctcctgattggcagactaacttgaaaactaggggatttgacccgttagtgcgaagctttttaacagcacttgaaaagcacgccgaaaatccagtttcaccagcatcagcaatcctttcacacgagttgtgcacgcgtttaataagccaaggtaaagtgatagaatagactaagagattttaagatgaaaagaaaaaagtaagaggggaaagtatgatgggtcaatcaatagctgatgcatttccagaggttcaagtgttagagcatgagcctttgtcaaaatacaccaatacccaaactggtggtccagctgatttgttggtatttccagagtcagtaacagaaaccaaacgactagtactttgggcaaaagaaacggatacgccattgaccattattggtaatgcaagtaatttaattgtgcgagatggtggtattcgagggttaacgttaattttaactaaaatggatgacatccaagtcaatggaaatgaagtggttgcggaagcaggtgcggcactgattcagaccacggaagtagcctaccaagcaggattaacgggccttgaatttgcagctggtattcctggatcaatcgggggcgcagtctttatgaatgcgggtgcctatgatggtgagattagtgaagtagttactagcgcagaaattttgacgagagatggcgagattaaaaatttaaataaccatgaactcgatttcggttaccgccatagtagtgtgcaagattatcaagatgttgtgctttcggcaacctttaagttacgttcaggggatgctaacaaaattcgagctcggatggacgaactgaaccgtttgcgagcttcgaaacaaccccttgaatatccatcatgtgggagtgtttttaaacgaccaacaggctactttactggaaaattaattcatgaggcaggtcttcaaggctttacagtggggggcgcacaggtttcaatgaaacatgcgggcttcatcattaacgttggaggagccaccgcaacagattacatggatgtgattcatcatgttcaagcaaccgtcttgaaacaatttggagtaacgctagaaaccgaagttcgaattatcggtgaagagaaataattagttggtatatattagaagagtttagaaaaataatttgattttctaaactcttctttgttcgaaaagaccataaagaacggcaggtccatggtataatgggcgttgaataaaatttggagggacggttatggatataaattggtcccaactattaacatggagtaacctcatcaatttaatcgatataattgtggtttggtttgtaatttacgagctaattatgttacttcgaggaaccaaggcggtacagctattccgtggaataattgtaatcgtagttattatggttggtagttggtatattggattaagtaccgtgtattggatcatgaaccaagtcatcaactggggcgtaattgccatggtgattatctttcagccggagattcgacggggattagaacatctcggtcgaggttcgatttttgctaagaatcattcacaaaatgaagccgaagaaagcttgatcaaagctttggataaagcgattcaatacatggctaagcggcgaattggggctttaatatcaattcaaatggatacagggctagatgactatattgaaacggggattccattagacgcggatgtttcgggagaactactaattaatatttttattccgaatacccctttgcatgatggggcagttattatcaaaaatgataaaattgcggtagcagcggcctacttaccattgtcacaaagtaacttaattccaaaagaattaggaacgcgtcatcgagcggcggtggggatgagtgaagttaccgatgctcttaccattgttgtttcagaagaaactggtgaagtttctattatgaaagatggtgaattaattcgcggaatgacacaagagtcatatctaaaatatttccgtacgcaattaattacggccgatgaaggaccgacaccattctttgcttctgttacagaaaatatttcgtcgttctttaaaggaaaaagggggcgacactaagtgaaaaagctttttacacaaaacttaggatatcgcctgattgcgctagtgttagccgtcctactttttgcatacgtaaagacagatcatttaaccgcaacccgcacttcgggaggcgattctaatcaaaataattcggctttgatgtcgactaagacggctactatcaccatgccggtcgacttggatgtcaatacttctaaatatgtagtgagcggttatcgagagaacgtaaaggtgactttgtctggaaccagtgcgctggtaacgaccttaactaacacgcgtaatttcaaggtgtacttggacttgcaagattacaaggctggaaaatatacagttaagtataaagttacgggtctgggaaaggatattaaatataagattgatcccgaattagctaagatttcgattgctagacgacgaactaaaaactttgaaattcgatatcgttacgataccaatatgatcaaagaaggctacaccatgggaaatgttaaatcctcaactacggaggttcaggccacaggttcagctacagatattgaacgcatttctcaagtagtcgcagatgttaatgttcctagcaacacaacggaagatatttctgctcgagcagtattgcaagctttagacgtaaacggtaacattgtaaacgtggtgttaacgcctcaatcggtaaatgttaccattccagttacgaaagtagcttctaaagcaaaaagttcagcttcaactagcagttcaagcagctctaaatcaagctcaggagaatctagttcagatgcttccagtgccacggatgaatctgcccagtccgattcaaatgcatccactaattcttcagctcaaacgacctcagatagtgcaacttccgacagtacaagcacatctgatgctagcggaaacacagatacacaggtgaattaacaaaggagattattaacaatgaaattaaagtattttggtactgacggagttcgaggaattgcaaatgaaacattgactccagaattagcgtttcaattaggccgtgctggtggttatgttttaactaagcatgctaaagatgatgaacaaccacgggttttagtttcaagagatacccgaatttcaggacaattgttaaaacatgcattgatctcaggcttactttcagtcggcattgaagttatggatatgggaattgttacaactcctggtgtggcttatcttgttcgtaaacaagaagctgatgctggtgtaatgattactgcttcacataatccggttcaagataacggaatcaagttctttggttcagatggttacaagttatcagatgaacttgaagctgaaatcgaagtacttttagatgctgataaagacaacttacctcgtccttcatctactggactaggttcagtgactgattatccagaaggtggattaaactatacggcctttcttgaacaaactattcccgatgacttggaaggtttgcatatcgcaattgatgctgctaatggagcaaccagtagctacgtttcacaaatatttgcggacttaaatactgagtttgatacgatggcaacaaatccagatggtttgaacatcaacgctggagttggttctactcatcctgaaggattggctaagtttgtggtcgaaaaaggcgctgatatgggagttgcttttgatggcgatggagaccgttgtattgccgttgatgaattaggtaatatcgttgatggtgacaagattatgtatatctgtggtaaattcttgagcgaacgcggacgtttgaaagacgatactgtggttacaaccgtgatgagtaatctaggactatataaggctctagaagctaatgatatgcactcggttaagacccaagttggtgaccgctatgtggttgaagaaatgcttaaagacggatataaccttggtggtgaacagtccggacacattgtcttcttagaccacaatactactggagatggtatgttaaccgccattcaattgatgtacgtagttaaacaaactggtaaaaagttgtctgagttagctgctgatgtgacaacttaccctcaaaaattagttaacgttcgagtacaagataagaagctagcacttgaaaatcaagcaattaaagatatcattgaaaaagttgaaaatgaaatgaacggcgaaggtcgagttctagtgcgcccttcagggactgaagacctacttcgtattatggccgaagctcctacaaaagaagcagttggtcaatatgttgatcgaattgttgctgtagttcaaagtgaagttggcgtggattaattagttgaattaaacttctacaactgaataaatttaaaaaactatgctattttgcaaaaaatggcatagtttttttatacgcgaaaagcattgctactatacctatttcggcatttgatatataccaattttaaatattaacgtttgacaattatataaaaccgttatatattaataatcgttatatataccaattttaaaaatttaaatatattaatttagaggtgcaagtagtatgtgtggaattgtaggagttactggaagagctgatacaaccaatctattagtaaatggacttaaaaaacttgaatatcgtggatatgattctgcgggaatttatgtcagcaatgctaatggtgaagatcatctggttaaagctcaaggtaagattaaaaatcttgaggaaaaaattacgaatgatgtcatgggaaccacaggaattggccacacacgctgggcaacacatggaataccaagtattgaaaatgctcaccctcatttttcagaagaccaccgtttttacttagttcacaacggggtaattcaaaatttcaaagaacttaaaaaagactatttatctgaagttactttccaaagcgatacggatacggaggttgtggttcaacttatcgatcgttttgctaaagcagggatggatacggaacaagcttttaaaaaagcaattagtttattaaaagattcatcatatgcctttgttttgatggaccgtcaattaccagaaaccttattcgtagctaagaacaagagtcctttgttaatcggagtgggcgaagacttcaatgtagtttgcagtgatgcattggcaatgattaacgtgactaaccaatttgttgaattgcacgacggggaggtagttaagattacgcctcaaagcatttcaattagtaatctagccggcgagaggatcgaccgtgctcctttcactattgatattgatcaagctgaagcggataaaggaacttacccatactacatgcttaaagaagttgatgaacaacctgctgtaatccgtcgtatcgaagctaaatatctagatcacgccggcaatattcactttgatcaagctttgttagatcaaattaatcaagcttctaaactttacatcgttggggctggaaccagttatcatgctggattagtgggtaagaagttatttgagaagtttaccaaaactcctacggaagtggtattagcttctgaatttgcttacgacgatcctatcattgaagatcaagccttctttatcttcttgagtcaaagtggagagactgctgatagtcgtcaagttttagttcgagtaaacgatgaatggcaaaaacccagcctaacaattactaacgtcgctaactcaacgttggctcgtgaagcggacttctcagctacgctggaagcgggtcctgaaattgccgttgcttcaactaaagcatatacagcgcaaatcgcagtggaagctttgttagcagtagcaatgggacgtgaaaaggctaattctacagctgtcaatttcgatattacgggacaattgagtaaggttgctaatgccattcaaaccgtggtcgatgagaagggtaagattgaaaagttagctctagcaactttacgagaaacgcgcaatgcgttttatattggacgaggtttggattataatgttgccttggaatcttctttgaaactaaaagaaatttcttatatccaagctgaaggttttgcttctggtgaattaaagcatggtacgattgctttgattgaagatggaacgccggtaattggaattattacgcaatctaagacggcggatcatacgcgtagtaatcttcaagaagttctttctcgtggtgctaacgtcatcaccatggttagtgaagatttggctaattctacagatgatatcttacttccagtagtggacgaaatgttgatgccattggttagtgtgatagctgctcaattgttagcttattatgctagtttgcagcgtggatataacgtagaccaaccacgtaatttagctaagagtgtcacggtcgaataaaagttaatatctaaaataagcggtacaggtgctaaaatgtatcgctatttttttggataaattgctaaacagtattgacactcatagttgtaagcgttatcattgttcgtgtaaggtagtggcgcatctcctacctgtacaatcaattctctttctctcttatgctggatccgactatcaaaaggtcaggatccttttttgttgtctaaagtgtcactagacacaacctcctacggcaaactatactagtagaagtggaggcagagcaatgaagagtaatgaaacatttacgctaatccaagagattacgcgcttagacggaactaaatatattgaaattggaaatatgatgatgaatggtcgggctgaattagccgccgaacgtggttatattaaatctgtccgaattttgcaattaaatatctcacattcccaacatgttattaattacgaaaagtatattggggagcgctacgagatgccggatgagtccatgacggcttgggaagaatggcaaaaagacgatcggattatgaaagaatttaatgcgatccttcatgaaaatcatattagtggctaaatcataaaaaggtcggtgagctaaaactgcaactcagcaggagcgcgaagccgaccttttattttagtaatagtaaataaaaattaacggtgcaaaatgttcgcattatgacggataaagtgctattatattcatgaatttaaatataagaatactgtacaaggtttgagcacaggagggtacatattatggaaaaagcatatatgatcggtactggaattgccaatttagcagcaggtatttatttgattcgcgatggtgggtggtctggtaaccagattacgatgtttggtttagaaaaacatggtgccaatgatggggccgccgtcgccgactatgagcaagaatatggaaatcaaagtctgtctaacaaccgaggctatttagccaagggtggacggatgttaaacgaagaaacttacgaaaatctctgggacattttgcggagtgtcccatctttggacaatccgggccaatcggttacggatgatatattgaatttcgaccatgcacatcccactcatgatgttgccagattgatggataagaagaatggaattcgtaacaatggtggagcagacgactataatcggatgcagtttaataataaagatcgctacttactatctaaattaatgatgatgccagagagtaaggaagataaattaaacgatattagcattgcagaatggttcgctgaaagccctcatattttttcaactaacttctggtatatgtgggaaactacttttgccttcaagaaggaaagctcggccatggagcttcggcgctatatgaatcggatgattctagaattcagtcgaatcaacactttggaaggggtaactcgtacaccatacaatcagtttgaaagtattatcttacctatgagaaaataccttgcggatcaaggcgttgaatttattaataaccgaaaaattacggcatttaacttcaaagacactccgctccgtgatgatattatcgttacgggacttgaatacgaagattttgagagcggtgaaactggaaaaatcgaagttgatgaaaatgatttagtatttgatattaatggagcaattacggatagttcatcaatgggtgatttcaacacgccagttaaagaaaatatggaatacgctccaagtgcagccctttggaaacaagctacagaacatttttataaccttggaaatcctgataaattctttaatgatcgagcccaaagtgaatggatgagtttcacggttactactaataaccactacttggtaaatgaaattagtcgaattacccaacaagaaccggggaatgcgctaaatacttgggtagatagtaacaacctcctatccattgtggtgcatcaccaacctcatttccatgcccaaaaggaaaatgaaacggtcttctggggttacttcatgttcccacgtaaaaatggtgattatgttgataaaccagtgattgaaatgacgggtaaagaaatgcttcaagaacttctaggacatctatcagaagttgaccgagcagctgataacatcatcaatcatgaagaagaaatcatggatagtatcgtgaatgttattccagtttacatgccatatgctagtgctttgttcaaccaacgggcagtgggagatcgtccagacgttgtaccaaagaactctaagaacttggcttttgttagtcaatttgctgaaatgccatttgatatggtctttacggaacaatactcaattagagccgctcaaaaggcggtttaccacttcatgggtattccagaatcacaaatgacgccggttcatcactatgaaaaagatccaaaagtcttgctaaaagcaactaagactatgttcagatgaaaataaataaatatataaataaaagtaccgcagaaaaatttaattttctacggtacttttttatttgaggattttttagttatgtgaaaaataatattaaacgtatttttgaggaacagttttattatgcacagctgtagaaaaatcagtgaaaattaattttgataaatctatacctttagatttagaaatataccatgccagtagttggaaaactgtagaacttataaaaggtactttatattcatcttcaatattaattaaatctagttgcttttcatcttcagatgtttcctctctaaaattgatagtataaaggttagatacgtatttcttttcatatgtttttagagataactctttttcatatatacttttttgtgagttggtttcaatgaaaaaaatataatgatctttattaacttctagatatggtccatgcatgaaagcttctaattcaaatccctgcgagggtactctaacaacttcagagaattttgttgccatctctgagcaagtaccaacacttggtccgtatgcgattgaagtgaattgtgtagccttagtaagagaatctatatgttgcttaataaatgattcagttttatttataacattatctatattcaaagctaatttctttaaatcttgtatttcatggagctcttgctctgaagtaataacatgattaactgcggcaattcgtatggctaggagcatcatatttaagacagtagccgtgaatcctaaagtaacgtaacccacgtgttctctaccaattaatatatctaaaattgtgtctgtttcttcagaaatttctgttttaggtagactagtaacaccaattgagaagacaggatgatcttgtttaactttttttagtgcctcaatggttgcggtactttgtccgctttgggaaataccaattacagcatctatgtgtttatcaattttttcatagtgtgaatagttatatggttcttgaatttccatttgaatatctgttattttttcaaaataatatttagaacttaaagctgcattatagctggaaccagttgccaatactaaaattttattaacatctttaggcattttgttgagagctttatcaatatttaatggatattgatctagaattgagagcattttagcttgttcagagtatatataagttaacattgttggtttatccattgttgatctccttaaatatgaaagtattgaattaagaaattagctataccatcctctaaattagaatcagtaacatggttcgcatatttttttacagtttcggggctattgcccatcgccacgctaataccagattgttgaaacatttctatatcatttaatccatcgccaaaagatatagttctactagatggaatattaaatttttgttggatagattttattgcagttgatttatttatatttttaggtattaattctatgttattggtattagattatgaaatatctaaatttttaatacgtgataatttagctgttatctgttttaaatgtgaattaggtgtatcaaagataataatcccgttcaagaattttttattagtagcgtcagttatacgaatatagtcgttaggattaggactagctattcggttctgatcgctatttttaaaataatgggggagatcttttgtataaaaaacgtgatgatcatcaaaaaagaaagcgcttaaattaaactgattacttatcgatataatatcttttacagcttctttgctgagataagtaaggtatgttttcttatctaaagaatagatgcacccattggatgcgataattcccaaagaacgatcgatatcattacgtattacggaggcagatagaaacattcggcctgtagagatataaaattgaacatcctttttttgaagcgattttattgtatctatggttttgttagaaacagtttgctgttcgtcgattaaagtaccgtcaatatccataaaaactaaatattttttttgcaatataattcctcctagttttgtttaaattttgtaccgcatgattctctaattattaatttaggatatggaataggtagatgtggtaatgtttcatgctcaatcaaatttaacaattgctgtaaagctgctaaacctaattgattattgttatgatcaatcgtagtcagccttggaatagtaaattcactattaggaaataaatcacaacttgcaagagcaacatcctttggaacttctaagttgtgatctttaagcgctcttatagcacctattgctacagcatcgttgatagtgactagagcttgggggagagagtctgtactaattaatttttcaatcgcgttatatccatcttgtacatagtaatcatttaaaattacatatttttcttgaaaagttgaatacatggatagcgtttctttaaagccattaaaacgttcttttgttatttttacatcgggtctacccccaataaacccaatttttttataaccattagcaagtaaatgttgtgtgatcatcgtgccgcttaatttttgatgtctttcaataaagacggaattaattgaactatcagtttgtgagacgactactgtgggaatattttttgaaagatcgtttagttcagtagcgtattcagggttaatatcaattttatctacttccccacctaagattattaccccatctacatgtttttctttcacaatattaaaggtttttatctcggcttttaaattcgtaatagtttcttcagcagtcatagtatttagaagcaagatagaatagttctgttttatacaaatttcctcaatttgagaaactaatgaaataaaatatggattattaacgtctgacacaattaacgcgatggtattagttttttttgaaaccatactgcgagcaatcatgctaggttgaaaattattctgatcaattattgtttgtattctttttctagtattttcagagacatttttactattattgataactcttgatactgttgaaacagatgtgtttgcaagcttcgctatttctttaattgttaaattgttctgcatgtaagttacactcctatagttcttgatggtaacttaattgtaggtgatatctttgtatttaacaatacttttttggtaacgttaccaaaaaatgtgttgacatgctttttcttttattataacattctggtgtggtgataacgttttcaataacaatggtaaccttaccaaaggagataaaatatgtcaaacaaagtaaaaacagtactctccgtagatctcggtggtacaaagctattgattggagaagttacaaaggatggagaaattctgaataagaaaaagtttttctcagatgtaacaagtcaagagagggctttaaattctataaaggaagctatagtcacatattggaacaatggatgtattggagaagttattgctataggaatttcagcagtcggtcgtataaatatacaagatgcgacatggtatgaaattaatccaaaaataagtgagccaatcaatttacgtacggaattgaaagatataactaaattaccaatttttgcagctaacgatgtcaattgcgcaacaattgctgaaaaaattttaggagatggtaaaaacgtagatgattttatatatatcaactttgggacaggtatcgcagctggaatagtccaaggaaagaaacttttatttggttcaacttataattctggagaagtggggcatatggtagttgactatgatagtcctacacaatgcatatgcggacgttatggatgcgtcgaaccgctggcatcgggattgggtatctcggaaagagcaaaagagttaattgataaatacccgtctacaaatcttaaggaagatcaaaatggtaggataggattgccagagctaataaaagcttatgaggataatgatcccattgcccaaacggttttgaatcgtgctacgcaagctgccgcctgcttgataatgaatttagtgtatactacagatcctaaaaaagtgattttaggaggaggaatgttaaatggtggatggttcatcaaacatataaaagagtatctaaacgatgaggccatgagatttgttacagatggtttagaagtaacaaatttaaatccgaatgaaatagctttgaaaggagccgctatgttagcactaaaggagggaaaggtttgaataaaaatataacggatattcttaaaataacagagaatctacataaacccattccactgaatgaagaaaacagtttagaaaaatttacgaatacaaaaaaaatccaaagaagaataccgattgaggctacttcacaaaagaaatggcttggtctaggacgtggggatgttagaaccaccgactcacgtaaaattaatataaaagcaaaagctagatatgattcgtgggatattggtgatccaagtgatggagattatgtagggtttggaaaaactaaagcatatatggaaatgaatcatgaagattggcaatcatatgatttgttatctttcgaaataaaatcaaactgtaaaaatattattaatccaaatattactattgaactaaaaaatgatggtgaaattaaggtgccggataaatatgaacgtgagggctatcatagtgttaatcttcacgataaagaattgcaaaccattaaattaaatcttaacggatttccacgagattctatcacgaaactaggttttgtaattgaaagtaatggtacctatagcaggaccgaaggagaaattaacttcgaaatagcaaatgttttcctagaaaaaagtgattcaactgatttaatcgaaggttggagacctaaaaaagataatattattttttctcatgaaggataccaaacagactcacccaaactggcatttacatcggggctgaaagcggacaatttttctattgtaaaaaacgatggtgaaacggtgtttacttcaaaaattagcaatgtaaaaacgaatgtaggtgaatataatatagccgatttttcaaattttaaaatgaatggcacatatcacattaagatcggtaatttagaaactgaaaactttaaaatcacgaacgataaagaattatggatgggctcatctgtaaaggcgcttaattttatattctccgaaagatgtggatatcctgttccaaatattcacggcgtttgccatgaagatgttgtagccttacataaaggaacaaagatgattttcaatggtggttggcatgatgcaggtgatttgtcgcagcaattaattcaaactgcggaagtcacgcaatcaatttttgaattagcagaacaatataaaaatatagatcaaaccttatttgataggtttattgaagaagggaagtggggcattgattttattctgaaaacagattttggcgagggataccatgcaactagcgctggagtatcaaggtggacggataatttacaagggaatatggatgatgcttctgctcgagtacataataccccttacgaaaattacattctatcaggtgtgtttatgcgaatttctaaggtgattggagcaaaagattctatgtataacacacttataagaagagcggaaaaatactatagatttgcagaacgcgaatttagtaaattgggatttaaaactactccaataatgtgggaacatacattaaatacatcaaaagcaacatatttggcaacaatggtatggtcaggtactttagtaaaccgggttttaaaagatcaaaaaattgagcagaatattaaatctcagatgcggcaactaatactttgccaagaaacagacggtattaaattagataacggccatattttaaaaggtatgttttatagggatgagacacataacgttttgcaacattttaaccatcaatcgcgtgaacattacttcgcacaagcatttgaagcaattataacaacatataaagatgacgaggaattttcaacgtgggttaactcagcaaaagagtatgcgaattatttattatttttacagaaatatacttatccatatactatgcatgctgatggtatatataaagaaaaggaatatacagataaagcaagttttgatgtccaacatttactggttgatagttccgctaaaaatgaatattcaattcaattacaaaaaggcgaaaaagtggctaatggcttttacgttaagaagtttccagtgtggttctcttttagaggaaataatggagtaattctttctgctgctaaatctgctggtattttaggaaatttattaaataaaaaagaattaattaatgttgctagaggacaactgcaatggattattgggcaaaatccatttgaccaatctatgatgtatggggaaggttatcgttatgctcagcagtattcggtttcttctggggaaattgttggtgaaattccagtaggaatcgagacaaatgaaaatacagatgtgccatactggccattctttaataacgcaacctataaggaagtctggataggaaacgttggtaagtagttaagtgttattgcagaagttattaaatataaatagtggttttatcgattttattgttttttatgaattttttcaatgaaaaggagaaaaaagtgaataatacatttgttactaaactgacgatgattgctggaaaaatatctaataataaatatattgcagctattcgtgatgcatttgctaatacaattccgattactattacagcagctttttttctattagttaataatgtacttctagatccaaagactggatttataaaaaatatgcctggtgctgattttataaggaatgttggaacgcaagcatataatggaacactaggaatattaggactactagttacctttatgataggtgctaaactagctaaggaatttaaatttgatgaagttattgccggaatagtatctgtaggttcgttcattgctttgattcctaacgttattactactgctacaacaacaggaagtaatgtaaaaatcacagcagctttaactcaagtacagactagtgcatcttcgatgattttggggattttagctgcactaataggtacacgattattaattatgtttaatacagtggacagattaaaaataagaatgccggaatccgtgccaccgggggtagctaaagcatttaatgctttattcccttcttttattactatcacaatcttctcaattattgaagaaactacgcttactctaaccggaatgccagtacctgatttgatttctaagttattacaggcacctttagttggcggttttcaaaccctaccaggtattttactatatgtatttttgtctacttcagtgtttatctttggtattaatggagctttcgtttttggtgcaatttctgaaccaatcctattgtcagcactacaacagaatattgatgctattaaattaggacattcagtcccaaatatggtgacccaacctttcttggatgcctttgtatacatgggcggaggaggaacgatgatttgtttggttattgccttactaattttttcgaaacgtccagatgaacgtcttatttcaaaaattggtggtgtccctagtttatttaatattagtgaaccaattatgtttggtttacctattgttttcaaccctatgtatgctatcccattcattgttacacctatggtatcgactacaattgcatatatctgtacgagtctgcattggattaaccctacgtatatatttatcccttgggtaacacctccgattatttctggctatttagctacttcaggtgatatacgtgcatcgattatgcaagctgtaattactgttatcggggttcttatatacgcaccatttgtattagcttcaaatagattacagaaaaacaaggagtaactcgttatggctgaaaaaacaattatgttagtatgtgctgcagggatgtcaacaagtttattagtttcaaaaatgcaaaaagctgctgaagctgaaggtgtagatgcagaaatcttcgcaacagctgcatcagatgcagataataaattggctgaaaagaatcctgatattttaatgcttggacctcaagttcgttaccttgaaggtaatttcaaagaaaaattggatattccggtagaagtaattaacatgcaagattacggcatgatgaatggtgaaaaggtattgaaggaagctctaacatcaatgggtgtttaggtttaattgggttttgaattaaaagcgcctttgttttttatataaataaatttaaggagcgtaacaatggatggacaagaacaaaatctagaagtaatcatgggactaattattaacggtggtaacgcaaagagctctgcatttgaagccatcaacgctgctaaagcaggagactttgaaaaagcagatgaaaaattaaaggaatccgatggctttttgaccgaagctcataatgtccaaaccgggatgttaactgaagaagctaagggaaaccatgctaaagtttcactgctaacgattcattcacaagaccacatcatgaatgccattacttttagagatctagctggagaaatcgttgatttatataaaaaataatatagtattttttatatattattgtttttaaaataaaagtaccgcagaaaaatttaaattttctacggtacttttttatttgaggattttaggcacgatatattgttgataatagttttggtaagttttagcggtaatctccgacgccgtcccactagtaccaaattctttaattttcttagcactgaaattagcttttttgatggcgctgactgagaagatttgtgcatcatcgcccactaaaaacttaacatttttagcagaggtcggtaacttggtatttttgacactttttagaactgctaacgtattggggacgtaatttctggtaaagctaaagatatcgattttaggtactttaataataatgttattgtccgtaaaattgatctgaaaaggaattctcgaattaatattattggcaatttgattttcaattaccgttgcactatcagacgtatcatctgtggtataatcactggaatctgatttagccatttggttgttggttaagttaggataagtctgaattccaagggccgctaaaattacaattacgatgtttgacttagaaaaaattctaaggggtttaaattttttagattttggcatcttcctgttccgtttcattttctatataataaagcattaataatagacaatatattacttatacaattatattaaacaatgtattaatacacaaacatttgtttgctatttggggcttaaatcgtattttagaatggagtaaatgatgattaaatatgcaatttttgatttggacgacactttgctggattttaagcggggagaacgagaaggtttaaccaaaataatgactaaatatggggtttctgacttgaagcaggggtttgatacatacaccaaaattaaccatcaagtttgggaagcaattgaacaaggtcaggctagagatgctctattgaatacgcgcttttccaaagcttttaatttattaggaattaaagttgacggagcaacggtggaggcagaatatcgtagtagcttagacactaatttttacaaactacaaggcgtagatgagcttctaagcgatctaaaagcggcgggggtccatttactagtaggaactaatggcgtcaaagaaacgcagcttcgtcgcttaaaaggttcaggactagagcattattttgaagactatttcatctcagaagacattgggtttgctaagccggataaacgtttctttgaaccgatgtttaaaaaatatgggaatttaacgacgaacgccgtgatggtgggcgatcggcttcaagccgacattttgggtgccaaacgcgcacaattaaacagtatttggtataaccctcaagcgttaccggtagttcaagcctaccaacctacttatgtggccaattcgtttaaacaaataaaaaaaattatcttaagcgcgtagtttaaaatgcatggataaactaatttttggtgcattttttagcgccgtgaaggtcaactagctaaaatgtttttcaagatttttaaatctttgaagaacatttttttagatttcatgtcactcttttttgattaattttaagaaaaatagggtatccagcaaaacgcgcagacaaggcgttttaatggataccctatactatatattgtattatacatatggataagcacatagatgttgtgttttcaagaattgaatttaaaaaatttcggagtaatctttagatatggttatttgaattatcgacagaaagaaggaccgataatgaatgcgcagagttagaacattcgacatcaatcatatcttaaatcgaggttatcaatcaacctcatatttcaaagtgaaacatttttttaatgtttggggtcccggcttaattgtgatgttagctgataccgatgcagggtgtttgatcactgcagctcagtcgggagctcaatggggatatacaatgattcttccccaaatcttattgattccagtcttatattttgcgcaagagatgacggtccgcctcggaattgtgactaaaaagggacatggtgagttaatccgagagtattttggtaagaagtgggcttggatttcggctggaaccctagctatttcagctattggcgcattattgacggaatttgtagggattgccggagtgggcgaaatgtttggtatttccaaatggattacaattcccattgcgaccgttttactgattgccgttgcgtttagcggcagctatcgacgggttgaaaaagtaggtgtcatgattggtttagcagagttggcttttttagtcgtggtagtaatggttaaaccgcaactgggcgatatggtgcgtggtattggtaccattccatggcataattcatcctatatttatttagtggctgctaatgttggagcagtaattatgccgtggatgattttttatcaacaaggagccgtagtcgacaaaaatttgggcgtggaaagtattaacaaagaaaaacatgatacttttgtgggaaccttggtaacgcaaggaattatggtaacgtttgtgattgcttttgcggcgacgatgggacttcagcaccagcaagtggccttagaaacggtcagtgacttagccagtggtttaagtgcatttatcggaagttatccggctaaattatttacgggaatgagtttattaggtggatcattagtggctgcgttagtcgtagctctagccggtacttggggcgttactgaggttttaaattggaaacatagtttaaacgaaccgcttcaaaagggaagtttagggttttacataatatactgcttggcacatattattggggccattttggtcttagctaacatcaatttagttaatttagcagtttcagtggaagtaatgaacgctttacttttaccaattgttttaggttttttgttaattctggaagcgaaagttttaccagaaaaatatcgcatgcacggagtttatcgttggttagtgacggttttgtgcatggtagtgatggggttcggtttatacatggttggacctattatggggatttggtagaaaggggattgaattttagatggatagtattaaaacagtactaagtgacaaaattgaaaatttgaaaaaaatgaaggtgacaaaagttgatggggaagtcgttaacttttacccttataaaattgctttagtagtagaaacattaacctctgatgcggcgctccagaccagcttaaaagaacaaatttttaatcgtattgctgatgattggaacaataacatcagcacagccgatattagacaagtttttcaagaaattttgcgtttaaacaatcaagctgagctattagaacggtacgaagcttatcgggaaaaagatattaaaaaatggaagaccgccattgacccacaatacaaacttaatcagctttttaatggaaatgacatggtggttcatgaaaacgccaacaaagacagcaatgtttttagtactagaagagatttaactgccggaatggtgggtaaatcagtgggattaaccatgatgcctgaaattgtagctaaggctcatttaagaggagatatccatttccatgatttagattattctccactaacttcgatgaccaactgttgtctaattgattttaaggggatgctggaaaagggctttaagattggaaatgcagatgtggaacctcctaagtcaatccaaacggcgactgctcaaatgtcacagattattgctaatgtggcttctagtcaatatggtggttgttcggccgatcgagcagatgaattgcttgctccatacgctaaattaaactatgaaaaacatttaaaagaagctgaagaatgggttgaagaaggtcgccgggacgaatttgctaaaacaaaaacggctaaggatatttatgatgcaatgcaagctctagaatacgaggttaatactttgttttcatctaatgggcaaactccttttaccacggtcggattcggattaggaacttcctggtttgaacgagaaatccaaaaagcaatcctcaaggttcggattaaaggtttgggcaagcagcatcgtaccgcgatttttcctaaattagtcttttcaatcaaacgcggtttaaatctcaatgttggtgatcctaactatgacattaagcaacttgcggttgaatgtgccactaagagaatgtaccccgatgtcttgatgtacgacaagattgtcgaattgacggggaactttaaagctccaatgggctgccgtagtttcttacaagcatggaaagatgcaaacggaaatgaagttaataatggtcggatgaatttaggcgtagtaaccattaatttaccgcgcattgcgctggaagctaaaggcgatcgtcaggtattttgggaaatcatggaagaccgcgttgaaaccgctcggcgcgcgctattattccgaattaaacgttgtcgtcaggcacagcctcagaatgcacccattctttataaaagtggtgcatttggcaaacgtctccaagatgaagacgaggtcgatgaattatttaacaagaatcgagcaacgatatcgttaggatacattgggttatacgaagtcggcacggctttctttggcgccgattgggaacaaaatccggaagctcatgattttaccgtaaaaattgttaagtacttgcatgattactgcctccgatgggaaaaagaatatggctatcattttagcgtttattccacaccagctgaatcactaacggatcgtttttgtgaagacaatattgaaaagtttggtaaggtaaaagacattactgacaaagaatattacaccaacagtttccactatgatgtgcgtaaaaatcctacaccatttgaaaaattaagttttgaggaagcctatcctaagtacgcttcgggtggatttattcattactgtgagtatcccaatttaaaacaaaatccggctgcgctagaagcggtctggacttgggcttatgaccatgtcggttatttagggaccaatgcttcaatcgatcattgctacaaatgtggttatgatggcgattttaaacccactgcccggggcttcgaatgtgcacagtgtggtaatcgcgatcctaagacttgtgatgtagtcaaaagaacctgtggatatttgggtaatccaatgattcgtccgatggtccatggtcgtcatcaagaaattgcatcacgggttaaacatatgggtcaaggtgaagccaatgaataaatcacgaccagtacgtttacctaaaaatccggaaccacaagcctggttggcagttgatcgtagtctccaatacattgccgactacaaaccttttaacatggtggatggtgaagggattcggtgtagcttgtatgtttccggatgcttatttaattgcccaggttgttataacaaagctgcgcaaaattttcattatgggacgccctattcagatgaattagaagatcaaattatgaaggacctcgctaatagttacgtacaaggtttaacgttgttagggggagaaccgtttttgaacacgcaagtttgtttgcgattggtgcgtcgaatccgagctgaatttggtaacgaaaaagatatttggtcgtggactggctatacttgggatgaactgatgcaagaatcatatgataaattacaactattaagttatttagatattttggtggacggacgctttttagaagctgaaaaggatttgagcttacagtttcggggaagtgccaaccaaagaatcattgacgtccctaaatcgttaaaagaaaatcgggtaattatttgggataagctaattcgataaatggggatgatataggatgagtacgctattaattaaagatttaaaggtggctgccggagaggaacctattcttaacggagtaaatttagaaattaaagctggcgaagtacatgcattgatgggaccaaatgggacagggaaatcaaccctatcggaaaccatcatgggcaacccgctctatcagattgtggaaggacaaatctttttagatggtcaagatattacaactatgagtgtggatgaacgtgctcgagcaggaatgtttttagcaatgcaatatccgacggaagttgccggaatttcgaacgccgattttattcacgcggccttaaatgcgcggaatggaaatcaaccggtggccattttaccgtttttaaatgaactaaaacaacaaatggattttttagaaattgatgaagactatgctgaccggggcttaaatgctgatttttctggtggtgaaaagaaacgcaatgaaattttacaaatgatgatgctgaaaccgagctttgccattttagatgaaattgattctggtttggacattgacgctttgcaaattgtggctaagggaattaatgcaatgcgaagtgatcaatttagttgcttgatggtgacccactatcagcgtttattaaattatgtggttcctgatgtggtccacattatgatgggcggtaaaattgtgaaaacaggtggcccagaactcgcccaagagctagaaaaaacgggttatgccgatttaagtggtgccgtggaggggagcgataacgattgaaacaaaattagaatcgccaactaaatatccgaaaattatggggattaaatatgatcctcaaaattttagctatgcatcgatgacaacgacgaagtggtcgtggaaagctaatccattagccttacaagagctacaggccgcaggtggcaggattcaagttttcggccccacgcagcagcttagtgtcgccggaaaacgattgttagaaagtgaattgcaagctaatgtggataatcaatttatggtggaacatgcccagcaatcttggcaaggacttgagctgattctaccagcacgggtgaccttaaaaaataagttgcacctcgaaattaccttcgaagcagcacaaccttccgcttttaccatgctattgaacgttggtgcgggaagtcagatacaattagaacgcgaaatccattatccaccagccagcacccggcttaacttattaacatgtggaaaagtggaagccgatagtcgattaaatttagttgatcggttgcagggcggacagtcgccacagcaaagtttatggatggcaaacttgcattgtcaaaaagacgctcagttagattggtcattttaccctgaggtgaagggtaaagtacttggaaaatgtatcacggtgcttgaagaacagggaagctctgctgtattcaaagtgggccaatttggtcgtcaggatgattggattggaattcaaggattaatcgaccatcgtgctcccaagacatttagccgaattaaaatgcgaggggttctttatgaaaaggcccaggtgtattttactagtatcggtaagattaataagggagcccatggagctaatgcagcccaagaaagccggttaatgaccattgaaccgcatgctaagggaagtgttaatcccctgttaattattgacgaaaatgatgtgcaagctggtcatgctgctagtgtaggacagtatgatgaagaagcgttgtactatcttttaagtcggggattaacggaggtggatgctaaacaaattttaatcaataatttcatggaacctgttttaccaaaagaaactgtggaaaagtaatggtggtaaataatgatagatgatcaaaaaatagcctatttagataatgcagcgaccatgccgatgccagacgaagtattggaagtaattgatacgtactaccatgcccataaagttaatgtgcatcggggaatgtatcggttagctcaccaagttacggagcaatatgaagcagttcgccaagctacggctaattttatcaatgctcaggactcgtcggagattatttttaccagtggcacgaccgatgccctaaatttagttgcttttggttatgcggaaaaacaacttcaaccagacgatgaaattattatcagtgttttagaacaccattcgaacttcattccgtggcaacgcgtggctcgtaaaactggcgcaaaattgaaaattgtcggtttagacgaccaacaaaatttagatatgcagcaattttccgaattgcttacggagaaaaccaagctagtcgccattacgttagtttccaatgtgctaggaagcattgtggatgctaagcaaattattgaacaaacgcatcatatggggggagtggttgtattagatgctgctcaagcagttggtcatttacccttagatgttcaaaaattggatgcggattttttagccttttctggacataaaatgtatggtcctaccggagtcggagttttatatggaaaacggaacttgttagaacaggttgagcctttgcgctttggcggggaaatggctgatgaagttgatgctcaaacggcgacgtttcaaccgctccccctacggctagaagccggtacgcctaacattgccggagttttagggctggggactgctattcaatatctacaaaagattggttttgcaactattaaacaacatgaacagcaattattgaatcagttataccaaggattacagcagataccagcaattaaaatttatggtccaaggtccgtagccgagcgccaaggggtgcttagttttaactatggaactattcatgcccatgatgtagcgaccattatcgataccgaaaatgtagcggttagagccggacatatgtgtgcagaacctttaatgcaagctctaggagtaagtagcgtcgtccgggccagtgtttcgtatatgaacacgacggaggatgtcgaacaacttttagcagcaatgaatcaggtgggccaaattttattatgagtaatattcaagaactttatcaaaaaataattgtaaatcatgctaagtatccgatcggacaaggagttttaccgcaatataattaccacgctaaattgaaaaatcctgattgtggggatgatattgaggtttatctcaaggtggtggatcagcatttggaacagattagttttacgggacaagggtgtatcatcagtcaagcttccgccagcatgatggtagatgctttgtcaggcaagcgcattttagaagcgcaacaattgatgcaaaattttcagaacttgattctgggaaaagattatgatgaaagccaattaggtgatttaatcgcgtttgcgaccctcaaccaatttccaacgcgtgttcgttgtggaatgctagcatggcatgcaatggcagatggattgaatcaaggaggaatcagctttggaaagtgaaaatccacagtttgaaaaagaccaattaagggatgaacgtggagcgatggatccagtcgcccccgttttttcaacaggagtggggattgatgctgaaacaatcaagcagatttctcaggctaaaaatgaaccggcgtggatgcttgaaattaggttggtagcttatcaaacctatttagacttaccgatgcccaaatttggtcccgatttgaatggaattgatttggatcaaattaagtatttccaacgtgctacggatcacatcgctcgggactgggaagacgttcccaatgatattaaggctacttttgaacggattggtgtgccagaagccgagcgtaaatatttggcgggctccgctgcgcaatatgaatcagaagccatttatagtaatctcaaaaaagatttggaaagccaagggattatttttatggataccgattcggcgcttcagaaacatccagatttagttcgccaatattttggaacactggttcctgctgatgataataagtttgcagcacttaacacggcggtttggtcgggtggtacctttttgtatgtaccaaagaatgtccatgctgatattccaattcaaagttattttcggattaatgctggaagaactggtcaatttgaacgaacgctcatcattgttgaagaaggtggaagtgttaattatgttgaaggttgcacggcgcccaactattccgaagatagtttgcatgcggcggtcgtagaagtttttgttaaaaaagatggctattgtcgttatacaaccatccaaaactggtcgaccaatgtctatagcttagaaactaagcgtgctcaagctgagacgaacgctaccatggaatggatcgacggtaacctaggttctaaagtgacgatgaaatatcccagcatttacttagttggccaaggagctacgggttccatgctttcaattgcggctgccggagccaatatgcatcaagatactggcgccaaaatgattcatatggccccgcatacgcacagtaccattgtttctaaagcaatttgccacaatggtggtcgagcagattatcgaggattgattaagtatactaaagccgcaaccaaggctaaatcgcacgtggaatgtgacacgattttaatggaccctgatagtgctagcgatactttcccagtcaatgatattgaaactagtgatggaacgattgaacacgaagcccatgtctctaaaatcgcagaagatcaattgtattacatgcaaagtcgcggtttggatgaagcaacggcgtcccagttaattgtgatgggctttctggagccctttaccaagcaattaccgatggaatatgcggtggaattagatcggctaattaagtttcaaatggaagatagtattggataaattgaaaagagtaatacgtaaaaatccctataatggcggcttttagacgtattactctttttttataaacaaaattgttgactttatgtcgttatcgtcatatagttatttatgttgataacaacataaatgtaaaaacaaaggggtaaaaaatcatggaaaaaacttttaaaactttagatgactttttaggaacacattttatttacacatacgataatagttgggaatacgaatggtatgctaaaaatgatcatactgttgattatcgaattcatggtggaatggttgctggtcgttgggtaaaagaccaagaagctcatatcgctatgttaacggaaggtatttacaaagtagcttggactgaaccaactggtactgatgtagccttggactttgttcctaatgaaaagaaattaaatggaacaattttcttccctaagtgggttgaagaacatccagaaatcacggttactttccaaaatgaacacatcgatttgatggaagaatctcgtgaaaagtatgaaacttaccctaagctagttgtcccagaatttgctacaattacttatatgggtgatgcaggccaagacaacgatgaagttattgccgaagctccatacgaaggtatgactgacgacatccgcgctggtaagtactttgatgaaaactacaaacgcattaacaaataaagtttagatttggagagaaaccaataatgccaagaccaagagttttaccgtacattattttaggattattaaataaaaatggaatgatgtctggtaaagatatgattagtgagtttaaaactgatataagtgagttttggacggtatcacatagtcagctctatcccgaattacaacggatggtggatgaaaagcagattaaggtggctgaagatgtggaagttaaggatcggaaagtcatcaattacgtgattgaagctaaagggcaagagacgctaaaaagatggcttgccgaaccgattactttaaagaatgatgaattaacatcattgaaactttattgtatttcagaccaacgagccccaatcttgcaacaaattttaagacagtgtttggcattgcatcaacaaaaggtagttcatttaaaaactcgaaaagaattattatttggagatgaaccagcgattaaagctaattacggacactatttgattttatccagagccatcgaacgtgaatcggactatgtcaattggctccaatctaaaataaactaataaaaagcgttgaatctaagccgagttaggctgataattcaacgctttttttgatggtttgttgttgtgaaatagcccaaagaattagtaacaaaatagtgagataattgataggtcctaaaaaatatttaccaatatgataaccaattaaatttcagattagacctatgctattcttaaagtggataaatgtttaattaaattgaggaatgaaggggttttggaggatgaagaaacaagtatatattattatcagcattgtgttagttattttaattgcgttattggcattagctaatacggcagcgacagacatcaactttttatttacgacgattaagataccactaattttattgattttggtttgtttattaattggtgcctttttcatgtttgtattgtcgatgagttctgctatgaagaaaaatggcgaaattaaaaatttgaaaaatgaagttgaacaaactaagcgcgaattaggacaaaagacggaagaattagaacgtcgtaagaaaaatgcagatacgcaactagggcgttaaatataaatagggttaatcggtaccagttcgtcgaacgcctcgattgtgggttatgatactttgaaaaataaccctaaatcatatatcttcaccaagaaatataatcagacgattaatcttaaggttaaaccacacactaaatatgtaacattgtatttcaatcaggttgattacgatggtaagcataaaaaattaaccttgtatgcgacaatgtatttcctagctatgactggacagactgctacaattcaaacgccagctgggtttacctttaaagatggtagtacagttcgaaagctagatattaaagaaaatacaggagaagttttgtatgaggttaagaaggcgccgtttaaacagcaaattaaaatttatcgcgggtattatttgttggggattacgatggtagtattcgttgtattggatgtgttgttggcttggattggtagtttttttgaaaaacgtaaacaggaagaatagttaaaaaagcatgaaaatcgatgagattttcatgcttttttatttggaaagtagatatatctcttagggataatacttgtactcaatatagaatatttaaaagtgatttttaatggtaaaattatttagtaagtaaatttttcgaattgtaggttgtaattttatgagtaaaagagaaaaatcaatttctactccaataattggaaatgttccctttagtgaagatgggctaaaacagttagagaaaatcgataataaaaaattactattagaataccccactgtttacattatttattctgaaagaaatggaatgtatcaagtgtatgtcggggaaactaataatatcaaacaacgaacaaaggaacattttagagagggaaatcgttatgcgaagggttctaatatgtttgtgattggtcatgaacatttctcgcattattaaatccttctttttaaacttaaataatctttttaggtaattcaaaaataatatttaattctagcacacttttaaaaagttagtttaagctcatttgagttaacttttagaatactaccccacaagcgtttgatccattacgtctaaactctattgcactacctttttatttttgatagaattatagtgttatggagagttggcagagtggtaatgcatcggactcgaaatccgacgacccggctaataccggcgcgcaggttcaaatcctgtactctccttattagtatctattagaccctaacgagaattaccgcttgttagaaataaaatagcttaaagcctttcatatcaaggtattaagctatttttttgttttttgtagttccgattagaaaaccactagaaattaagaagttggttcccattttaagagcatttttcgaaaaatttcattttatctaattcaccaaaaaacattccaatcataaagaattagtagattaataaatttaatgagtatagaatttttatatcctgatctaactgttatcaagacccagagttgtttattctaaatttacattagtcgattttgtcactttataatgtctaactacaataagcacattgatgaataaacgcttaaattatcaagaaaaagacttgtacgactttgtaccattttaaataaaaaagctccctagtcattggactagcaagctaaaataagtagatatttgagaatataattaatattccatcaaacttaatgtatcatagtctttaattttttcacggccattgaggtcttttaattcgataaagaaggcagttcccacaactataccacctaatttttcaactaattcaatcgtagcagcgattgttccacccgttgctagtaaatcatcagtaattaaaaccttttgtccgggtttgattgcatccttttgaagatacaattctgattttccatattctagaccgtaagtagctttaacggtttctcgggggagttttccctttttacgtgctggtgcaaaaccaattcccatttcataggcaactgggcatcctacgataaatcctcgtgcttcaggtcccacaatcatttcaacgcctttatctctagcgaatttaatgattgcatttgttgcttgacgatacgcctcaccattttccattaaaggagaaatatcacggaatgttacacctttttctgggaaatcttgaatacttgcaacgtagtcatgtaagtctaatgtcattttacgacactcctttgttatcaacattcatcagtctttcaactatagctgatagttcatcaccactactatagagtaatttttcctgagtttgaattaattcttcacgcttcttatacgccggtgcctcagtaagctggtgctgttctgcttcagcatcgatgaaaagaagtccgttttctattttaacaaaattcaactcaaaaaacacttttatcatgaagttgatcttctcttgatctatttttaattttggtccaagttgcatgatatctgttttagttaatttttgagttttaacaataccaaacatctgcttaaattcaatccgactgggcatgccactagcgtagaaatcgacgttatgaaagaaataagtaatgattctttgcggctgcgtagccttgataagttcggccatttcggctagattatcaggacaatctactaatacaatcgtgtcatttttctcaattgctgacgaactgtaataatagaatttacgattaagattttgactttgaatcaaatccatcaacttttggttaaaaaagacatattgcatgtcactcttaaataagtttttattcaaatttgaggttcgttgatcaataacttgcaaaccatcgatcttgatatcatccgtcataaattgaaccgaaacattaccacgccactcgttagtattgatggttcccaccaaactaatgggattggcaacattatttaagacatcagctaactcactccgtttaaacgcaatggcattgatattttgattaccatcatcaagcgtgaactttaaatgtgccccatctttaccaattgcctttgcttctttaacacgaacgtcttcaagttcaaacttcggtactgggttattcatcccaaacggtcctaaaattttcatttctgaaactaacttttcagttaattcttcaatatttacttttaaatcaatttgtaattgcggctgttgcttaaaatctaaattagctaattgacccgccttttctaactggtcagttagagttgcaagctggtcagcccctacggtaaccccaatagccatatgatgtccaccgaacccaatacactgttctcggatagggttaatagcttcaaacaaatttagagctgcaacactacgtccagaccccttataaattccattaccaccttgatcactaagaacaatcgtcggtttattagtttgttcgacaattcgactagcaataatccccaagactccttgatgccagtcgtgtccagcaataactaacgtttggcggctagcatgctcatcatcaagggcaatttcttcagcttcagtgtaaatatcactaactaatccctgacgcttcgaattaatcttattaatctcttgtgcaattgttgtggcttcttcttcatcaaaagttgttaataattctactgctcggctggcattttctaatctaccaacagcattaattctcggagccacagtaaaaccaatgtcttgctcgtcgaaatgacttacatcaacacctgatatttcgattaacttctgtaagccaattctctgggtgtttggtatcatttctaatcccatctttaccaaaaaacgattttcatcggtcattgaaaccaaatcagcggtcgttccaattgcatacaagtcaaggaattcttcgggaatttcttcaagtaaagctgttgccaccttaaaagctaccccgactccagacaaatcaccaaatggataggctccctctgggtgacgtggatggataattgcatatgcctccggtaatacttctggtatttcatgatgatccgtgacaataacattcgtaccctgatcttcagcaaatttgattgcttcatttccggcaactccattatccacggtaatgattaactgaaccccttcatcattaatgaagtgttggtactctttcaaattaggaccataaccatccttaaaacggtctggaacaaagtattgcacgttagcccctaactgatctaacgtttcatacataatggtcgtacttgtaaccccatctgcatcataatcaccgtatacaagaattttttcgttgctttcaatcgccacaaaaattcggtcaagggctttttgcatatcgtgcagtagcatcggatcatgtacaatcgacatatcctcatcaataaaactgagaatgtcctcgcctgttttaaaacctctagcgaccatgattttaaccatcgtctggctaagtttggtttccgatgccagttgatcgatatcaacatcatctaacttgctaacttgccaattaaatctgttatctttcattaattaactccaactactttcgattaatcaagggactattaacgattaaatcacccattttaggaaataaggtgtacataatcgctcccactcccattattttaggtacattaacttccctaagattttcaataatggccttattcaccaattcagccacttgattcgcgttaatcacgaattgttgaacaccttttaaatatttaccactaggatcagcaatactaaagaaattagtatccattggtcctgggttaattgtgtggacacggatgttgcggtcatacatttctagacgaagggcgttagaaaagccgatcacgccgaatttagcactagcgtacgtagttgttttagccgtcgcaattttaccagcaatagaagcaatattaacaatatctgcagcttctccaacgtgatccaccattaatggcaacattaagcgtgtgaacttaatcatccccgtcaagtctgttgcaaacgttcgttcaatttgttcaaagctttgatttaataagttttcaaaatatcctagcccagcgttattaactaataaatcgactgttccaaggtgtgaatcaatccatgctcccgtttgacggatctggtcctcattcgttaaatcacatgccaaacagaatattctattttcacctttaacaatacatttttcagccgttgcatttaacttttctgaatttcttccaattaaaactaaattatcatagtgagtgctattcaaaatcgcaatcttttgccctaaaccgctgcctgctccagtaattactgccgttgtcattaaaatcactcctacttttaaggtaatggaatatcaattatgtcaaaatcacgaacaactttactattactaaaaatttcctttgcatcactttcaagttgcttactgagctttcccgtataacgagctgaaatatgggttagcaataattgccgagcattagcttgcttagcaattttcgcagcttgaatattagttgaatgataataattacgtgccaagcttccctcttgttttccaaaagtactttcgtggaccaaggcatccgcatctttagctaaaagttcgatattaggcgtttgtcgtgtgtcgcccaaaactgtgactactcgacctggttgaggttttccaatgaaatcttgcccgttaataactctaccgtcatctaaagtaacttctttaccttgcttaatctgaccataaataggtcctgaaggtatcgctaattcttttagcttatcgactaaaagttcacctggatggtctttttcctttacccgaaaaccgtaacttttaattcgatgatctaactcagcaacgttaacaatataattttgatcttcaaataaaacgccctcttgagctatttcaacaaattttattcgatatgaaagttttgactctgaaatacgcaatgaggtcatcacaaagtctttaatgccagttggcccgaagatggtaagttcttcgctaccaccctgattagaacgactacttaagaaacctggcaaaccaaaaatatgatcaccatgaagatgggtaataaatattttatcaattttacggggttttatattagtttttaagatttgatgctgggttgcttcaccacagtcaaaaagccaaacttcattactttcatctaataattttaatgctacactagtaacattacggaatttaccggggcttccggctccagttcctaaaaattcaagttgcatattttcacctatatctattgacttaacaatccattttacaatacttttaattgtatcactagcatcgactataattctaagatatccttgctatataagtattattaaataaggaggtttctttttgaatttaaataatttcataaaatcaacggccgaattacgttcccacttaattcttaaaggggatcgagaacaattattttttgtttcagggatcatcgttaatacccttcaaaaagaaatattacttacattaactttaaatcctcatcagcttccccttagtcaatttcgaaccaaaactattgaagcaccaagagaagctaaaatattattgttcaaccccgaaactaaactaaaaactcatacatttggatattatctacatgatcaatatctagtaatcaagtaaaaagtcagtgatgagaacagaattgtttaagattaaacattcctttctgtacttaccactgactttaataatttttattctacaaattcaaatacaaagtccaaaatttgaacactatctccattacgtgcacctaagcgacgtaattcatcatcaattcccatgccacgcatttgacgagcaaagcgtaaaagactttcatcatgcgttgtatcagtcatcttaaagagtttttcaatcttttcaccctcaataacccaaacgtcatcaacattttcaatggtaaagtctttttctgaactaaattcatatgtcttttcagtttcttcgtcagaagtagcaattaatgaatgctgtggaatttcttccaatgcatctgcagttcgagcaactagtttttcaagtccattatgggtgatagaagaaattgggaaaatttcaaaatcagcataacgttcatcagctcgaacttgtttttcaaatttcttaagctcttcatcggatccaggtaaatccattttagtcggaacaataatttgccgacgttccaacaattcaggattatatttttttagctcttcattgatttgacggaaattagtgaatggatcttcttccgtcattccactcatgtctactaaatgaagtaagacccgtgttcgttcaacgtgacgtaggaattcaaaacctaatcccacaccttgagaagctccttcaatcaaaccaggaatgtcagcaataacaaaatcacgaccatcatccaattggaccatccctaagttaggtactaaggtcgtaaaatgatattccgcaattttaggcttcgcactcgttactactgaaagtagtgttgatttaccgacagatggaaatcctaataatccaacatccgctaaaaccttaagttctaattgtaattcaatttcttctccaggttccccattttcagaaatttcgggagcaggatttcgagggctagcaaaacgcatatttccacggcctccacgaccacctttagccaccactaattcttgtccgttatcggttaaatcaccaattacacgtcccgtggttaaatcgcggacaattgttccacctggtacggaaatcacgagatcttgagaactacgtcccgtcatttgtttattcatcccatttttcccagaatccgccttgaacttatggcgatacctgaaatccatcaaagttctaagacctgggtcaacttttaagacaacgttaccaccacggcctccatcgccaccagctggtccaccgttgggaacatatttttcacgacggaaagctacaatcccatttccaccgttaccagctttaacattaattttaacttgatctacaaacattattttctcctaaatattttatttcaccgagaaattcctatccatttgttagtgtaccctattttccgtgcactgataaggacactttgatagttttagctactttttctggaattccgagttcttcaatttctttcaaattagcatccctaattttattcaatgaaccaaacgacttcaacagcttgttccgcgttttaggtccaacaccttgaattaaatccaattgggaagccaacgaatttttggcatgcaactgacgatggaaagtaatcgcaaaacgatgcacttcatcttggattctttgaaccaaataaaagccctgacttttaggatccaactgtactcgttggtcttgactaccaaaaatcaaatccgaagttttgtgctcatcatttttaaccatcccagcaactggaatatgcaaacttaattcattcaccaaaacatcctttgctgcattaagctgaatatcgccaccgtccattaaaatcaaatcaggcaaagattgtttctcttttaatagtctaacatatcggcgacgaattacctctctcgtactggcagcttcatcagcatgatcgaccgtatttagcttaaatttgcgatacatctttttatctggttttccatccgtaaaaacaaccattgctgaaactaattcagagccttgaatatgagaatggtcaaatgcttcaattcgatgaccttcagggattccaagcgcatcagtaatttccttcattgcgcctgttgttttactttcatctaactccattaatcggaacttttcctcaagggtaatttgtgcattttctttagctaactctaacaagtttttcttttccccacgctgtggagtgcgaactgggatacctaaaatttcggccataattttattatctaagccactcggtactaaaatttcatttggcaaaaccttatttttattattataaaattgaagaataaaagaagaaagctcatcacttacatctgttgcgattggaaataatctcttctctcgtttaatcaagcgtgattgccggataaagaagatttgaatagaaagccaccccttatcaaggtagaaattaaacaaatcacgtggcgtgctatcatttgaaataatcttctgcttctcaaccgttacttcaatataatgaatttgatctcgtatgtcggctgcccgttcaaattccattgcttcagaagctttttgcatttttgtttgaagggactgcttaatctttgcgacatttcctcgtaaaaatgatttaattttagcgatttgttggtcgtattcttctttaggtacctcttggaaacaggctcccaagcattgccccatatgatagtacaagcaaggacgaccttgaaatccattgcatcggcgtagtggataaaccttttccaaaaaatggagtgtttcttcagcagcatacacgtttggataaggtccaaagtaaaagcccccatctcgacgaacacttgaaacaatttccattcgtggatctttttcattcgtaattttaatataaggatagccagtcccttttttcaattttatattgtaataaggttggaacttttgaattaaagtaatttctagtaaaaaagcttctttatcgctagaggtaacaatatagtcaaaatcggctatttcactcactagtttcgccgtttttccctcatggctacttttaaagtaagagcgaacacggtttttcaagtttttggcttttccaacgtaaatgatttggctattaagatttttcatctggtaacagcctggtttatctggtaacaatgccaacttatgttcaatgtgttctgatgccaatttgacccctcctagtttacataataactcataacattatactctgtttttaccatattcagcaactaaaacgaaaaaacaggtagtagtattacactctacctgcttttcctatttgactaaaattttagataagaattccttggcccgatctgtcttaggattgctaaaaaattcttctggagttgatttttcttgaatacccgcattttccataaaccaaatttgattggaaactgactgggcaaatcccatttcatgagttaccacaaccattgtcatccctgatttagctaattgacgcataacattcagtacctctccaaccatttcaggatctaacgcagaagtcggttcatcaaaaagcataacatctggtttcattgctaatgccctagcaatcgccacccgctgtctttgtcccccggatagattatctggataggcctccgccttatctgataatccgacttgatccaacagactaagggcttgttgattggcttttgcttcacttaatcccttaactcggatgggagctaaggtaatatttttaagaacagtcatattcggaaataaattaaaattctgaaagaccatgcctactttttcacgaacatgttcaatttccttttgagtttttttagttaaatcttcaccttctaacgaaaccacccctgccgtaggtttttctagaagtgttaagcatcgaagaaatgtacttttaccagctcctgaaggaccgatgacactaatgatgtctccatccttcacttctgctgaaatatcctttaatattgtattttttccatattttttggtcaaattttcaattttgatgatttctttagccattattaaacttcctttcatagaacttaagtaaacgtgatagtgagaaggtcattacaaagtataaaatcatcgcaacaacgattggagctacccctcgataagtatctgattgaacaatctttaattgataaattaagtcggttacaccaataattgaaacaattgaactttccttaattagagaaataaattcattccccaaagctggccaaatattctttaaagcttgaggcataattacaaaacgcatccgatctcgcttattcaaacctagactttcagctgcttcacgttgtccatcatcaacggaattaatgcccccacggattacttcggcaacataagctccactatttaaagatacagcgataattcctgcggtaagggctggtaaattaacaaataatccaagtccgaagtaaacgaacattaattgaaccatcaacggcgttccacgtacaaattcaacatacgctgctgataaaccacgtaaaactttattgtcactcaggcgtagtaatgctagtaatgtcccggtgataaaaccaaaaataacccccaaaattgaaataaggattgtataacccactcccatggcaaagtacttccaataatgaatcatagaggtattaacggtgtttccttttaaatacgtccctgcttctttaagatattgtggtaataaatttttagcttttatcttactaattgtagtatttattttctttctcaggactggcgaatttttaggcattgcaaccgctgtgctagtttcatcatcatttaacgtgaatccgccttggataactttaataccactattattagcagcatatgcttcagcagtaggtttttccatgacaaccccttcaactttattagtttgaagagctagaattaaatctgcccctttttgaataccactcactttggctccatcaatttgttttttggctaaattgtactgaattgagccagtttgagctgcaatctttttatgtttaaaagaatctttatttttataaatacctgcatcctttttattaattagaatgctttgtccacctttatagtaaacatctgaaaaatcaactgatttacgccgagcagcactaggattcatcccggaaagaaccatgtcaaccttaccggtttgtagtgcaactaataaagaatcaaaatccatatttttgatcttcaattttacacccaaatcatcagcaatgtccttagctacgctaacatccattcccacatctttactcttattattagatgttgtttgaaattcgtacggggcataatctggactggtaccaagtacaatataaccgcgcttcataatccgatcataagtaacatccttttgatctgccttaatgctagttgtaaaacccgaagttgcaaaaactgttatagctaataacgctaacatgataaatttatatatttttttcatcgccatcatcctttattcaatataatgttactaatatacatctacaccctttgatataaaagaattttatttaatatatgaatttttatacattaaaatatataatattcactataaatgtgaataatttttattttctgacaaatgaaattttttttggtattatggtcggaaagaggtgattagaaatgggactcactgttaaaagaaatgataatctcgaaaaaatgttcgatcaattaacaactcaaactaaaacttccgtagaggaaaaagaaaagaaaaataaatttcttgctaaaggtactaataaaaaagattcaaaaaaataaaccacaatcatcagcattaatgctgttaattgtggttttttatttacttaaagttgccgggataacgcttttcaagtgtggcaatattttgtttggccacctcatcgaaaggaatatcagcccattcagcaacttgagaaagataccatagaacatcgcccatttctttggtaagttgttctttatcaagatcagctccacggaacgtatagtttttaactaaattcacaacctgtccgctttctccggctagtcctaaagcacaattcgttaaaacttgttcattgccaaatagggttttatttgcagtacgttggtattcattaaattccatgctattctcccatcctatcttcaatccatttccagacttcttcttttcccattttagtttgagcagagaacatttggaaagcactacttccatcaaaatctagtgcctttttaattttactttcgtgttgattccattttcctcgagcaatcttatcactcttagtagcaacgactagaacgggaatatcataataacgtagatattgatacatggtgatatcatcgtcagttggttcatggcgtgcatcaaccagtgaaattacgcctttaagctctttacgggaggtgatatacttttcaatcatcttcccccatttttcacgttctttctgagaaacttttgcataaccatagcctgggacatcaacaaagaataattgatcttcaacccggtaaaaatttaaagtttgtgttttacctggttgagatgatgtccttgcatatgatttacggttaattaacgtattagttagagacgatttcccgacgttagagcgtcctaccaaagcaatctcaggataaccttgttctggatattgatcgggtctcactgcactaatctgtaattctacattatggacttccattacttctccaccttccaatttctgcttttaatgataacatggatcaacaaaaaaagaacccgactaaaggaacttatagcctgattcttaaaacttagactacgatgcttgttcgtcgattaactcaacttcaggttccgcaccttcaataacagtctttttatttaccgtaacttttgcaacatcattgcgagaaggaatttcaaacatgatatctcgcatgacattttcaataattgatcttaacccacgagcaccagtattacgactaatagcttggttagcaatcgcatgcaaggcctgtggtgtaaatttaagttctacgccatctagacctaataacgtcttatattgcttaactaacgcattcttaggctctgttaaaatatgaacaagatcttcctcagttagtttttccaacgctgaaagaattggtaaacgtccaataaattctgggattaaaccaaagttaagcaaatcttctggaataacttgttgcatcaaactcttatcttcttcaacagtggtacttgcatttgtaccaaagccaatggtcttatcacctaaacgatttttaacaattgtctcgatgccatcgaaagcaccaccaacaatgaataagatgttcgtcgtattaatttggataaactcttgttgtggatgttttcttcctccttgaggtggaacattagcaatcgttccttctaggatttttaaaagggcttgttgcacaccttcaccggaaacatcacgagtaattgacacattttcgcttttcttagcgattttatcaatttcatcaatgtaaattattccacgttctgcagcttcaacattgtagtccgcattttgcaataacttaagtagaatattttcgacatcttcaccaacataccctgcttccgtcaatgtggttgcatcggcaatcgcaaaaggtacatttaaaattttagccaaactttgagccaagaaagtttttcctgaaccagtaggtccaattaaactaatattacttttctggagttctggttcatcttcgtcagctttagtttcagccatcttattgattcgtttgtaatgattatatacagcaaccgataatgtctttttagcttcttcttgtccaataacatattggttaagataatctacaatctctgcaggagttggaacatccgtgatttcagttggtgcgttttctgaagccaactcttcatcaatgatttccttgcaaagatcaacacattcgttacaaatataaacatctgggccagcaataattttctttacttgatcttgggtcttaccacaaaaagaacaagtaactggttcattcgtttgttgatcatcaaacaattctgtcacctctcaaatgatttttaccactatcatcatagcaaaataaacgactataagccaatttctataactttagtggttaataaacaaaaacgattttgagataaaacctcaaaatcgttaaaaatagttttaattattttttagcagcctttgattttggttcttcaattgctgagtctttgataagttcaacagctgatttaatagcaacatcatgcttgatcatatcttctgaaagagctgagcgaacagctttttcttccatgccgtattgttctgctaaatctttgatttcagcagcaacttcgtcatctgaaggatcaatcttttcagcttcaacgattgcttctaaaacaagagttgtcttaacacggttttcagcaccttcgcgtaattggtcacgtaattggtcttctgatgaaccagttaattggaagtacatttcagggctaattccttgttgttgcatgtttgcaagatattggttaacttgacgatcaacatcttcatttaacattgcttctggaatttctgcaatttcagcattgtcaacagcagcttgaacagcttctgtttctttagcatcactagcagcttggatcttacgtgatttaatttcttcttttgtcttaacttttaaatcttcaagagaatcaacatcttcgtcaacatccttagcgaattcatcatcaagttcaggtaattccttagtcttgatttcatgaatcttaaccttaaacaaggcatccttaccttgtaagtcttcagcttggtagtcgtcagggaatgtaacattaacatctacatcttcatcagtattatgaccaatcaattgatcttcaaatcctggaatgaatgagtttgaacctaatacaaggtcgtaattgtcagctttaccgccatcaaaagcaacgccatcaacagaaccatcaaaatcgattgttactgtatcgccgttttctgctggtttgccttccttaagaactaattcagcttgttgttcacgtttcttttcaatttcttcgtcaacttcttttgaagttacacgtgtgctttgcttgataactttaacgcctttgtattcgccaagcttaacttctggcttaactgtaacaattgcacttaggacccaagcttcgcctttttccatgctttcaacatcaacttgtggttgatcaactggttcgataccagcttctttgatagcagcttcataagcctctggtagcacgatgttcaaagcatcttggtacaatgcttcttcaccatacatcttattgaagatttggcgtggaacgtgtcccttacggaatccaggtacgttcaattgttttttagtacgatcgaacgccttatcaacgccttctttaattttgtcagtacctacttcgaaagttaatttaccttcgttagtacctgttttttcccattttgcagtcattgtgttccctccgacagatgatttatttcattacaattctggattgcatacgcttataatcttaacgtatatggtttgaaaagtaaataaaaatacaacaaaaaaacccgcaaaagcgggtttttattaagcaattaagcttagtcgtcgatttctgatacaacaccagcaccaacagtgtgtccaccttcacgaacagtgaacttagtacctttttcaatagcaactggttcgataagttctacagtaaatgtaacgttatcaccaggcataaccatttcaacgttgtcaggtaattcaataacacctgttacatcagttgtatggaagtagaattgaggacggtagtttgagaagaatggagtatgacgtccaccttcatccttagaaaggatataaacttcacccttgaacttcttgtgtgtttggattgagccaggagcagccaaaacttgtccacggacaacatcttcacggttaacaccacgtagaagtgcaccaatgttatcaccagcttcaccaacatcaagagtcttacggaacatttcaattcctgtaacagttgtctttgttacgtcttctttaagaccaacgatttcaacttcgtcaccgactttgatttcaccacgatcgatacgaccagaagcaacagtaccacgaccagtaattgtaaatacgtcttcaacaggcatcaagaatggcttgtctgtagaacgttctggtgttggaatgtattcgtcgattgtatccataagatccatgataactttttcttgttctgcatcgccttcaagagctttcaaagctgaaccgcgaagtacaggaacatcgtcaccagggaaatcatattcagatagaagttcacgaacttccatctcaacaaggtcaactaattcatcatcatcaacaagatcagtcttgtttaagaagacaacgatgtagtcaacaccaacttggtgagcaagaaggatatgttcacgtgtttgtggcataggaccatcagttgcagcaacaactaagatagcaccatccatttgtgcagcaccagtgatcatgttcttaacgtaatcagcatgtcctggagcatcgatatgagcgtaatgacgcttttctgtttcatattcaacgtgggctgtgttgattgtgataccacgttccttttcttctggagcagcatcaatatcagcgtaatctgaagctttagctagtcctttttctgacaacacttttgtaatagcagctgtcaaagtagttttcccatggtcaacgtggccaattgtaccaatatttacatggggttttgttctttcgtaatgttcttttgccattaatacgaacctcctgtatgtcgtaagaatcactcagcattcaaaatgaataactagatcctttaaaaaatattatactacatcctccacgaaaggcaaagcaccgtcagagaatcctctagtattgtataataatcgagtttattttgtaaactaaaatattttattaattcgatttttttcttactcttcaaataagttaatcatgatttgattcaattctttgaacgcttttatatctttcccctcaaaaaactgtttctttagcgctgtaagccattcttctgaggtaggtaggacacgctttgaaaaaggataggaaagctcatatagcaattcagcttgctgctgtagcatttctgattgaactggatcattatagttttcaatagctttttttatttttttccacatctcatcagttcccaataagtcctttggaaacacttcatattctttttcatcaatccaaataaagcgcactggttcctctaatctcatcaaaaccaagtcttttaaaattgaaacacgcgttatttggtttaaaaacggatcaactaaattaaactttgccgcccgtttaaagttactccatggtaaatagtaagctttttcaattacagcagcttgctgaataaccttcttatcacctagatggtaaaaatctcgttcgttttctttcacagttttaggaaaagcaatcgcatattcattttcttgattctcgagaaaatttaaatatttctttaaatctggtgtagtctcttcataatagttaaaaagttcttttcgagctaaactaaaaatttttgtttgaaccagcgcctcaaaataatctctaaaagtatttttctgctcaatgaacttagctggttgatcacgaatcaactcaatcgctgccttaaattgtttattttcaacgtaaaaatgaattaaaacacggattaattcatcatcttgttttaattcattctcagtttcaagaatatgaatagcctctgcacgttgacctgttttccaagcttcatttgctttgctaattacattcatattattcatcgtctttagatttattcgattttttgctcttcttatggtgttggttcacttccataattactggtaaaattactggacgtcgtttcgttttatcgtataagaatttacctaattggtcacgtacatcttgcttcaaatgtccccaatcgaattctttattatcgagattagcttgcactgctcgttcaaccaagtccgaactttcttggattaaatctacacttgttttagcgtaaacaaaccctctagacgtaattttaggttctttaataatgattttcttcttacggtcaattgttactaccgcaatgaaaaccccatcttcagataaaattttacgatctctaagaacaatgttaccaatgtcccctacaccaattccatcaatcattgtatttccgaccgtaattcccttacctaggaacatttcgccatctttatactctaaaacatcacccttggaagcaatgaaaatttgattttcattgagaccaacttgttctgcaagttctttatgagctactaaaagacggtattcgccttgaatcggaattagaaattctggcttaattaaattaagcattaactgtaaatcatctttgctagcatgacctgtagcattagctcggtctgaaatcgacctaacttcggctccagcacgatacaacatatctttagtcttagcaaacgttgtttccatcgcatgggaaggattagtagctattactaccaaatcacctggttgaatcttaagatttcccttttttctagcggccattttttgcaaggctttgatgggttcacccaatttaccagtttccaaaataatcgtttcttctggtttcaacttatctagttggtttaaaggaacaattaattcgttatctggaatatttaatttgtttaactcgatagctgtattaacaatcttctctaaatcatgtccagttaaaacgacttttttatctgatttagctgcagcgtcaatcacctgttgaatccgtaaaatattcgaagccactgaagctacaattacccgaccttcatggtatttaattgtctcagccattacatcagcaatatcagtttcattagatgaacgttctggattttcagcgttagcagaatcacttaaaagcgcgataacttttttacttccaatttgtgctagccgtctgaaatctgtctgatatccatcagtagccgtttgatcaaatttaaaatcaccagtatatacaatttgtccttccgtacaactcaacacaattccaagtgattcaggaattgtatgcgtagtcttgaaaaacgaaacagtaacgtcgccaaaatcaatttctttcttgtcatctaccacatggaaattatcgaatgctttaagttcagggtcatcattaaccgtaattttagccaaggcaatggtcatttctgaaccaaaaaccggtacattaatttcttttaagaaatatggcaaagcaccaatcgcgtcagcatgcccgtgagttaggaacacacccacaattttttctttgttttcaaccaaatatgaaatatctgggattacaatatcaatacccagcaattcattttccgggtattttagtccacaatccaagatataaatatcatcatgaatttgaacagcatacatattctttccattttcgcgaacaccgccaaatggaattatttttattgtgtcactcattttttcacctacataaattaattttttattttccgcacaatacatacttccttaattctagcatagattaaacgccaaaaacaaaaaagcctcctgaattaacaggaggcaaaaaaatataatattaacgacgaagaccaagactcttgattaaatcacggtaacgctgtacatctgtcttacgtaagtaagcaagaaggttacgacgatgaccaattttcttcatcaatccacgttgtgaatggaaatctttacgatgaacacgtaaatgttcgttgatttcgttaatatcagctgtcaaaactgcgatttggacttcagcagaaccagtatcgccttcgtgacgagcatactttgcaataatttcgtttttcttttcttgtgaaattgccatgttaaaacacctcattctttaaattccccaagactgagtaaatcgtcggcagatcgatggactaagtaatgggtttgctattatcaagcagtatctagtttaactaatataatgaaaattttcaagtgcattcaagcattgcaataattacgggtcatctgtataataatattgttgtactaaccatattctggaggtgaataaaatgccagttatcaaatctgcaatgaaacgcgttcgcacaagtgaaaaagctgctgctcgcaaccgctcacaaatgagtgcaatgcgtacaagcatcaaagcattcgaaattgctgctacaaacaacgctgaaaacgctaatgaacttttacaaacagcttacagtcgtatcgaccgagctaagtcaaaaggtttaattaaagctaacaacgccggccgtaagaagtcacgtttagctaaaatgcttagcaaataaaaaaacaccggatttccggtgttttttattttcatccatttttaaatttaactaagaacaactcaaagagttccttcggatctcgttgggttgtttttaattgttcttctaaatcaaccaaccccatataagcattttcgagactttgaatattaaactgacgcacagattgcattgccaacttaattcggtaaggatgcgcctttaactcttgtgctagctttccttgtgagaaacctctctccatcaatattttaacttgcagcaacaatcgaaattggctaactaaagccgcgtttatccttagtggctgttcttgatttaggagtaatacagaataatcatcgattgatttacgtaaatttccttgcattaatacattgattaaatcaaaaacattttggtttaagctcttaggaactaatttttgaacagcattcaaatcaattttctctgttcccgatgcatatacagttaatttctgtaattcattaataatttgtgctaaatcattatccgtccttaaaattaattcatctaacgcatcactgtcaatttctgttcgtttctcatcaacgtattgctggataatcttccgagtatcgctttctttcggtgaattagcatcgataacttctacaatcttttttaagtctttgataattttcttccgaccatcgagtttttcatattttgcagcgattaacataattgtagtaggttccggatttttaatatagctaagcaatccgtccaagttaaactttaatttagttttttcaccagtcaagaatacagggttatttaaaatgaccaaacgataatcgccaaaaaaaggggcagactgtgcatcatctaagaccatccctaagtccacattttcaaggtcatacgttcctacgttcattaccctttgatcttcaggaatgaaatcaattaattcttttttgaccgctttctggatatagttatcaggaccttcaaccaaatagattgacttcaattgcccttgtttaagtttttttcttaaatcagttaatttcattgaataatactttccttttcatctattcctgtcttccatcttcccataccattcaaaaaatatctataagaaatcattccttcatcctgtgtcgaagcgtaaggaatctccattgaattcaagcgatttataacttctagatttggatgtccataccgattatgacgcccagctgaaacaatagctaatttaggtataattacttttagaatttcttcagaattagccgtcttactcccatggtgccctaatttaaaaatatccacccgttgatttaatacaccactttctaacaatttacgttcaccagctaggtctagatcacctgttagtagtaaatttttaccacccacattaccagctaaaactaaagaatcaccattttcaccctttccagcttgaaacggatacttaatttccattggtaagtgatcaattttcgtccccgctaagcacgcaatcacctttgtattgcgtcggataaatggcaatatttttcgttgataattttgagttgtatcaacccccaccggaaaaaccaaatttttcactttaaaattgtttaaaatttcactggcttctccaatatgatcaacatcttgatgcgtcaaacataaattatttaacttagatactcctatactttgtaaataattaattgaactattcttagcgatggtatgcttcattgcaaccggctttttgccaaattgcattttaccgcctgtatcaattaacgttactgttcgattaaacggttcacgaattaaaatgctatcgccttgacctacatcaaaaaaggtgatttcaccatacgggttcaatttaaaccaactccacaaccccagccaaatcagactatagaacgttaacgctcttttcttaaatttactttgctttgttgaaataatttttagcgctaatatcaccatgaataaagtgatcagccgcgaaggtttaccaacttgaattaatcccggtaatttatctaaatatttcaaagttacttcgaacatcataataattggatttaatagcaccattaattggggaattgcaaaagctacaattacgattggaacgattacactcgaaaaaatcggaacaataattaaattaaaaaccatcgttaataagtggattttgtatgttgaaaataaaataattggtaattctaccaaaaataattttattcctgttgtccagctattttccatttgttgcataattaagacaaaagataataaataactaagttgcccacccatctgaagtaagacaaacggattaagccataaattgactaataaaactaagcaccagctatcaagcgtgctaacttttatagctatttttttagttatcaactgaactaaaactaataccaccgcgcgaaataggctagtacttcccccacccaaaataaaatagagggggtaaaactcctatttgggttatctccatcgtttcccttttaattttaaatctagtaaaaacaatttcaattaacttgatgaaataaaacacatgtaatcctgaaatacaaaacaaatgaataatacccatattacgtaacttagtgctattttcttttagataatccgtctgttccccaaggataatccccatacaataactctgtagtggttcctctaactttgtacatcttttcaataattttttacgccaactatgtatcttagcaatcaaactatttttagttaaaatattatattctatcagactagctttactcactttaaaataaactgccttaccatacataatccgtcgaaaatcaaattgatttatattcgttggtcgttcaagcggttcaatattccccttaattttaaattcaactactttttgagttttactaattttttttaaatcgtcaaccgttttaactggaataaaaacttgcaagcctttacggttaagattgttagtatatgctcgaattgaaacgccgtcttccattggcttaatttcatcgggataaactctcaaatcaatttcaatatcacttctactttggttataagtattaattgaatttgctttatgactaaagtgaataaaaaaacagacactaatcaataatgcctgcattaccactgtaagtttttttaaacatatagttctaattaaccaaattattaataataataaaaatattttagctctggtaaagattaatccagacagtaaaaaaacagctactgttgcccatataaaagaaacctcattcaccttctcttaaaatatgattaatattaattttatctaaatcatcctctgagaatttaatctgcttaatttcgacattctttctttttaagagctctacggcatattggtcattatggtaatttctaagataattaattttaataattccggactgtaacaacatttttgtacactgtaaacagggaaaatccgttacataaacttctgcaccatccgttgcaacaccaaacttagcacattgcagaaccgcattcatttccgcgtgtatcgtacgaacgcagtgtccctctactaaatagcatccttcgtcaatacaatgtacgtctccagaaactgaaccattatagcccccagctattactcgccgatctctaacaataactgcccccactgaaagccgcgtgcacgtacttctgagtgataacagggttgcctgtgtcataaaatattgatcccaatcaattctattgtccatatcatttccatccttaatttatacagtaattgcatcttgtagtccttcaaaaattttatcaccaatcccctgtacttgctttaaatcttcaatggatttaaattcgccctgttgttcacgataattaataatttgttcagcttttttatctcctacaccattcaatgtcaacaattctgctttagaggcagtatttatgttaactattttttcagttgaactatcggttgtggaagggctgctacttgaaatactcgatgaaccaactgcacttaattgtgacggatcagaattttttatctcacccttaatcggtacataaactacttgttgatcagacaattgagtcgcaaggttaatatttctttgatcagctgatttagtcattccaccagcaatttcaatcgcatccattattcgcattcccgactttacttcataaactccagggcttttcacggctcctttaacatccaccattattttagaactagcaagtctctgggcgtgagtctccttatcttgtccactcgccattggcgttgcagagtttgagctgctttgtatagaactggacgaactagtcagattgtttccaatcatcttatcagtactatcattacgccccgctcctaccaaaatacaaaaaaacatgaccactattgtgactgttatacctgttattataatttgtttttgatatttttcccaaatttcttccaacatttttgcacctccttagctaacagaagatacaaaaaaagattggaatttattttccaatcctttaaatagtcattttagtcttgattttaataatacttctacagtttcagggactaggcctttaatgcttccacccatttttacaacttctttaattaaactagacgaggtaaattcccacttagaattagctggtataaataccgtctcaacttcttgatttaaatattgattcattccagccacctgaatttcaaagtttaaatcttccccattgcgaacgcctcgaaccaaaacatctgctttttcctgtgtaaaagtttcagccgttaatcctgttaccgatttacaagcaacattttcaaggtctctagtcacttgcgtaattaagttcacgcgttcctgtggtgtaaataaagccgatttgttggtgttaatcgccactaccaccgttaattcatcaaaaattttagcagcacgtttaataatatctagatggccattagtaattgggtcaaaacttccaacataaagagcctttgtcatcgtattattctcccttataaattacaattttggtaattccataatgttgttcacgtacacgatttaaatatccaattttctctggcaattcaacttcatcactgacttcacaaatgataattgcgtctgaagttaataaatttaaaccaattaattcttgaaggtctttctcaattgtttggagtgcataaggtggatcaaagaaggccatcgaatatttatttccttttgtagctaacatttgaataattttcttggaatcgcccttaatgacttcaaaacgatcctttgccttagtcacttcaacattttctttaattgttttaatagcagcaaattgtttatcaatcaacgtagcgctatccatccctctcgaaacagcttcaattgatagtccaccacttccagcgtacatatctagcactaagcctccatcgaaatatggcccaataatattaaatatattttctttaattttatctgttgtcggacgggttttcattcccggtacgggtttcaaacgacgtccaccaaaatcacctgaaataactctcactgttcatcttcctctgctgaataatcttgactatagtcaacccttaaatctgatcgtggagagatatacgcagatctcaccatctcaaatcctcgaattttttttaaagattcctcaacattacttttattaacgtaaaggattaaataatgcatatcttttgaaacataatcaacatcgccaatttttttgatgggtccgatttttttgatgttattaaaaaatacaataatactttgacgttgtactatattcattctaatcttcctctatgatttgtttctgttcattaagtgcttgtctttgcgaagcacttatatttagtagtacccccatggtagccgataaaaccatcatacttgaaccaccataactaatgaaagggaacgtaacccctgtaattggtatcaaaccagttattccaccaacattgaagaaagtttgaacaactagataagttgcaataccataacaaacaagagcatcatacattttactggacctagtaccaagaataattgctctgaaaataatgacaaataggatcgaaatgataattacaaccataatcaaacccaattcctcagcaattaccgacataataaaatcagtattagcttcgggtaaatatcccttcttttgaatactatttcctaaaccaacaccaaaaatcccaccattaccgagtgcgtaatatgaattaaccaactgattaccagcacctttagaaagttcaaaaggatgcgcaaatcctaccagacgttgaagcatataatttgaggtatgcacatcaattttcgaagcaactgtagttaatagtataaaaaatgctgctaatccagcaaatattcccgcaacacttttacgataatttttaccacctgcaaacaaaattacaattgcaattgccgcattaatcgttgaacctcctaaatcatgttgtaaaaagttcaataaaattagcgaaccaatcataaccattggactccacgttaccttaggagaaatttcttctcctaattcaatccgatgttgatgtagtgacaaaatatttgataaatacaaaataataaataacttcaaatattcagccggttggatcccaaaagatccaatatagatccatccagtagctccatttgtattcgaaccaaaaaatataagaaaaaaagacgctgcgtacataactaatgcaccaatttttaatatacctttattcctaaaaccttttttgttaatcaaaaaaaagaacatcatgattacaattccaaccattacccaaactgcttgttttaacagataacttttagcgctaattccattctggatataaaaatcagcactggctgagtagaccattacaattccaaaaatactaagtataagatatgggattattacccataaatctagatacggcaatcgctctttaaatcgccttggaaaccaatataaaaatttttgcattaatatttcacccttatcctgcataatacctaatctattatatcgtactacgctccttaaaaataaaaaaagacgaaaattaaattttcgtcttttcttaattattttttagcagccattttacgtttcttagcagctttttcacgttcatttgtattcaagatttgcttacgcaaacgaatgtgatcaggtgtaatttcacagtattcatcttcattcaaaaattcaagtgattcttcgagtgacatatgaactggtgttttaaccttagcgatatcttcagaaccagcagcacgcacgttagtttggttacgtccacgagtaatgttaactgaaatatcattttcacgactgttttgaccaacaatcataccttcatatacttcagtaccagcatctgtaaagataactccacgatcttgaacagccatgatagcgtaagtggtaactttaccagaattaattgatactaaagtaccattacgacgacctggattccagttcttaatttgtggtaagtattcttggaaagtatggttcataataccatatccacgagtcattgataggaattctgtagagtaaccaatcaatccacgtgaaggagccaagaaagtcaaacgagtttggccattatcagtagtttccatattcttcatttcacccttacgttgtgaaagtgaatcaattacagaaccagtatattcatcaggtgtatcaatttgaaccatttcataaggttcacatagcttgccatcgatttccttgatgataacttctggacgtgatgcttgaagttcgtaaccttcgcgacgaagtgtttcaattaaaattgaaagatgaagttcaccacgacctgaaacaatccatgcaccaggatcatcagtatcatcaactcgaagtgaaacatcagtatgaagttcagtcttcaaacgttgttccaactgacgtgatgtaacgaacttaccttcgcgaccagcaaatggtgaatcatttgttctaaatgtcatttgtagtgtaggttcgtcaattcgtaacactggtaatgcttctggatgttctgcatcggcaactgtttcaccaacgaaaatgtcttccatacctgagatagcaatcaagtcccctgctttggcttcgttgatttccaaacgtttcaaaccaaagtaaccaaacaacttagtaactcggaagtttttctttgaaccatcaagtttaagcacggaaacgttgtctccaaccttgatccgaccgcggaatacacgtccaataccaatccgtccaacgaagtcgttgtaatcaagtaaagcaacttggaattgaagtggttcagctgaagaatcttcaggagctggaattgtatctacaattgtatcaaaaattggtttcattgtgtgttcttggtcagctgggtctgaagaaaaactagaagttccattgatagctgaagcatatacaactgggaactcaagttggtcttcatcagcaccaagttcaatgaatagatcaagaacttcgtcaacaacttcttctggacgtgcgcctgggcggtcaatcttgttaacaaccacgattggtgttaaatgttgttccaaagcttttttcaaaacaaagcgtgtttggggcattgttccttcaaaagcatcaacaacaagcaaaacaccatcaaccatgcgcatgatacgttcaacttcaccaccgaagtcagcatgtcctggagtatctaaaatgttaatttgtttatctgcataacgtacagcagtgttttttgaaagaattgtgattccacgttcacgttcaatcgcatttgagtccaaagcacggtcttcaatttgaacgtgttcgtctaatgtatctgattgtttcaataattcattaaccaaggtagtctttccgtggtcaacgtgggcaatgattgcaatatttctaatatcgtctcttaaattcaatatgtttctccctttcgtttttcaatggcttaacataaaaaaacctgtgacgtctaattcgtcacagcataatgctatttcactatactcattatagcagaatatgcttttttcgtagcaactagtacaacgcccgattttagcacattaatagcctctccgtcaacataccctacttttaacccaaagaccgccgctaaagcgtttccagcagcaaaatcccatggttttaagctagaaacatatccaatttgtttacccaaaagtactcgaataaattcgattcctgcactgccaataactctagctcctagcgttcttttttcaacgtcttggaagtgatatgcattattaactagcattgggccacttaacccgattaaactttcttctagagctagattggctggaggattgattacatcttgatttttatataccactccaattcccggtccaccatgtaataaaacatcacgcatgacatcgtaaatatatcccaacaaaggttttccatcttcatatagagcgatcattacagcaaaatcttcacgttgcttaacaaaattcatggtcccatcaattggatcaatgacccacatcaaccccttggcatcagttaaatcattttcagattcctcagctaaaattttagcatcagggagtaattgacttaacgcttcaataatgtgagcttgattaccacgatccacttcagttaccaaatctcggcggttttgtttttcatcaacttccaaatgctttcccatcttttcaaaaataaattgacgatctttgactagaaattccactattttggcgtctaattgaagtaagaaatctttatctatatttttcattttcaatcaccttaatttttttaatatttaaatcttttaattgtttaaccgctaaaaatggttccataccagaattacttaaaaattccttaaaaagtcttttttcttcactcttattgggcactactgcttgaaacttgcgataactttcaacaaatttttcgcgtttaaccccttcttgataagctttttcaactatagcgaagaaattaattacatcagttaattcggctgtattccagcgttcatcgattgggtaagaaaaagtttcttttatactcattttaatattccttttaagatttattttgtgttaatactatattatatattatacttgttgttagacgaattggaggtttttatcttgattaaaatgaacgatatcactcgtgacggaaatcccgttttacgaaaacgtgctgaaaagcttacttttccgctcgatcctaaatatctcaaagttgccgatgaaatgatggaatatttaaaaaatagccaagatccagctattgctgaaaaataccacttaagagccggcgttggtttggccgctccacagattggtttatcaatccaaatggcttcagtccttgttcctgggccagataataccatcgatttagaagaaacattagttaatcctgtaatcgttagtcaatcggttcaaattgctgctttggaggaaggcgaaggctgtctttcggtcgataaagacgttcctggatatgttcctcgtcacgaccgcatcactgtgcgttaccaaaccttggatggcgaagaaaaaactattaaactccgcgattatcctgcaattgtttgtcaacatgaaattgatcatctaaaaggcactttattctatgatcatatcaataaagaaaatcctttagatattgaagataatgctattttaatcggctaattataaaaaagaagctatgcctgcatggtgaatctcaaaagttaagttatctacttaatttctgactgttcattcctttgtggcatagcttcttttttatagcttactgagatcatttaagtaatctttagtctgacgattaattaaatatacaacgtctaactctaaatggttttgattaagccaaatatctgaaacctttaattgaggtccatcttcgtcttctaattgatgctttcggcaatattccgctagaattttgttgattttagattcaattaatttaatatccatactatgtttgaggttggcgtgataattaaacccaacaacggattgaccccaaacgtctgcgaccgattttccctttgctccatcaaattccataccatccattttaagctgcttagctacttggatcatggcattatttacgattgtttcacttgcatttctaactattgtagccgctttagcaattcttttcctttttatatatgtaagaattaataacactgcaactaaaataattaagaaaattataattaatgacttaattagcatttttgataccagtccctccgcctttcaaggctatgtttctatacttatatcagcctctatgataaaatgtttaaagatgcgttgtagtaatacaacttattgaacgggcaaaacttttatttttatttgaacacatttttacgaaagaaggaagaaaaaaacatgatttttaaagtttattatcaagaatctaaaaaagaaacaccacgtcgtgagaatacacactcactatttattgaagctgaaacgaagccagatgcaattaaacgcgtcgaaactaacaatccagacttcaacgttgaacaagtcgaattgctcgaaggtaaggcactcgaatatgaacaacaaggtgtaaattacaagctagtggagtactaagcttatgggtaaaattaacattaaaaataacgagactgccgtttatgcaatcggtggccttaatgaaattggcaaaaacacttatggtattcaatttcaagacgaaattattgtcgtcgatgctggaatcaaattccctgaagatgaattattgggaattgactacgttatccctgactaccaatttctagttgctaaccaacaaaaaataaaagccttagttatcacacatggtcatgaagaccacattggtggtattccgtttttactacaacaaattaacgttccaatttatgctagtccacttgctgccgctttaattaaaggaaaacttgaagaacatggtctattaaaaaccaccgaaatccatatcattgatgaggatacggtaatcaaattccctaagactagcgttagcttctttagaaccacccactcgattccagatactttaggagttgccgtccacactccttctggggtgattgtcgaaactggtgattttaagtttgacctaacaccgactacacatcagccacctaaccttcaaaaaatggctaaacttggtgatgaaggcgtattgttgttaatgtctgatagtactaatgctgaacgtgatgaatttactaaatctgaacgttgggttggtaagtccattcgtaaaattttcgaagaagtcgagggacgaattatttttgctactttcgcttctaacatttctcgaatccagatggcaacagaagctgcactaaaacatggtcgtaaaattgcggtttttggtcgctcgatggaagcagctttagttaacggccgtgaactaggataccttgatattcccgatgacgcattaatcaatgccgaacaacttaaccatttaccagctaataaagtattgatcatgtgtactggttctcaaggtgaaccgatggcagcgcttagtcgaattgccaacggcactcatcgtcaaatttcaatacaacctgatgacactgtcgtattttcaagtaatccaattcctggtaatactatcagtgtcaataaagttattaacgaattagaagaagctggtgctcgcgtaattcacggaaaagtgaataacatccatacttctggtcatggtggccaagatgaacaacgtctaatgttgcgtttgatgcaacctaaatattttatgcctattcatggcgaatatagaatgttgcaattgcatactgaacttgctcatgactgtgacgtaccattcgaaaatagctttattatgtccaacggtgatgttttagcccttacaaaggactccgctcgtcgttctggtcattttagtgccggtgatgtatatgtagatggaaatggtattggagacatcggaaacgttgttttacgtgatcgtcaattactttctgaagaaggacttgtggttgtcgttgcaacaattaatctaaaaactaagatgattgaatccggcccagatcttttatcacgagggtttgtttacatgcgagaatccggtgaattaattaatgaaggtcggcgtcgaatgtttgcgagaattcgtcacgcaatgcgaaatccgcacgctaatgaagcctctattaatcgggcaattattgatgatctacagaaattcttatatgaacaaactgaacgtcatcctgtaattattccaatgttaattatggattaataaaaaacgcaatcttatcaaactctgagataaatctctaatgattgaaaagattgcgtttttatttagctataattttgctaaacatgaaaagttccctttcccaaattttaaaaggtaaaataaaaaacgtctcaactaacctgggttaattgaaacgtttattttttagttaattttaacgtacgctaccagcaaaacttgggtagaagtatgatgaaattgttgaaaccttagcattttgaccaaatgttggagcatttgcatattggttgttaccaagataaatagcgacgtgatatgttgaaccagcgctaccccagaataataaatcacctggttgagcagctgaaacagatttctttgttacatatgattccatagctacagtatagcttggaagactaataccagctgaatgttggtatacatatgaaacaaatccagaacaatcaaaacctgaagttgttttaccgccccatacgtatgggattgtgttattagctaaagatctagctaaaccagtaacagaaccagtattttgagtagttgttgttgtagcacttgatgatgcagctgaactagcaacattggttgtgttagtagttgttgcagctgaactagtatgtgtagcatatgaaggagttgtagcagcacttgatggtgctacactagttacagcttgtgatgttaccgcactacttgatggtgcaactgagcttgcagctgatgatacagctgaacttggtgctacgctagttacagcttgtgatgtcactgcactacttgatggtgcaactgagcttgcagctgatgatacagctgaacttggtgctacgttagttgcagcttgtgatgtcactgcactacttgatggtgcaactgagcttgcagctgatgatacagctgaacttggtgctacgctagttacagcttgtgatgttactgcactacttgatggtgcaactgagcttgcagctgatgatacagctgaacttggtgctacgctagttgcagcttgtgatgttactgcactacttgatgatgcaactgagcttgcagctgatgatacagctgaacttggtgctacgctagttacagcttgtgatgttactgcactgcttgcaggtgctacatatgttgtagcagcactacttggtgctggtgttactacagtttgagcagctgcactacttgcttgaactgtaacttgttgagtagcttgaggtacatatgtacttgaagcttgagttgctgaaccattggcagcaggaattgttaaactttgtccaacaataattaatgaactgctaagattgtttgctttcatgatggcattaacagatacaccatatttttcagcaagaactgataaactatcaccgctctttacggtaattttagtaacttttgagtctgttttgcctggaatattgatatcttgtccaacaaaaatcaagtgactattttgattaatgttatttagtgattcaatgcttttaacggaaactccgtatttttgtgaaagtgcccaaactgtatcactcttttgtacctttacagaatcagcatgagcaatcacttgtgttccgcctgcaacaagaagacctgctccggccgcaccagctaataataatttggatgcatttgatttagaattggtaaccatataagttcgtccactccttaaattttcgtataatttttatgatttctatcgttaatattcaaaataaattagaattggttttttgcacgtgtttaatactatcatttttaagatattttgaaaacactttttatacattaactattcatcataaattaaaaaaatcttataaatcccgccactacaatgtttaacaaaacttaaaaaaaacaaataacttttgacactttttttcttaaaatcctttatttcatgcatgtttatctaatgttacaccaatattacaaaaaaagagtattgttacaaagaatgtaacaatactcccaagttaaaccatattttttatacataaaaatgaatttttatgcattttttgaattctttactggtttccataatcccataattacaccggctattaccgcaccaattactacagatagaacgtagaataatttatgatcagctaacgcaattacccatataccaccatgaggagccggaacactaaccttccaaagttgacttagtccaccaccgattgctgaaccaataatacttgatccaattacacgaagaggatcagcagttgcgaatggaatggcaccttcagtaataaatgatagtcccagaacccagtttgaaattccagcttcacgttcttgtgccgtaaatttcttaggccaaaatgttgtggcaattgctgtagctaaaggtggaatcatcccacccaccattacagcagccatcaaatcaccatttttagttgaagtaaacgctgcaatcgcaaacgcataagcagccttattaaatggaccacccatatcaattgacatcatcgctgccagtacagcacctaagagaaccgcgtttccggttcccatgccttctagcacaccagttatccatgcattaacggccgcaaacacagggttaactgcaaagaacattaatgcgccaaccaaaagtaaactcaagattggataaatcaacattggttttaaaccttcaagtgtcttaggaacaaatttgaataactttttcaaaccgttgacaatcaaaccagctgcaaaaccagcaattaatccaccaataaatcctgaaacacttgttgtatgcattacgcttgcagctgactgggttgccatataaccacccacaaccccaggcattaacgctggtaaatcaccaattgattgagcaataaaaccggcaagaattgggatcaagaatgaaaaggcataattaccaattccattagggaaagtaaaccacaaactagttgctgacgtatatcgctcaataaagaacgaaagagccatgataatcccaccaccaactacaaatggtagcatatgagaaataccgttcattaaatctttataaatttcattccaaaaaccaccgtttgatgattcagattctgacgcttcatttccagtagaatggaatgtagtagcctgattagcttcaaccaaatcaattaattcatcagctttattaatcccatcaatgactggtcgatttaaaagtggtttaccatcgaaacgcgccatttcaacttttttatctgctgtaatgataactccatcagctcgttcaatatcttcattagttaaacgatgctttacaccttcggaaccatttgtttcaactttgatctcgattcctttttccttagccgcctttttcaaagcagcctcagccatataagtatgagcaatcccattaggacaagctgaaaccgcaacaataaaggactttttttctgaatcgactggttcagttgtttcagcatcatgtgaatcttctacatcttttgctgcttctgcagcttcaaataatgccaaaacatccgctggagtttcagcgttcttcaattttcctaccaactctgggtcaatcagcaaactagatagtttagctaaggcctgtagatgcgcattattcgccccctctggagcagcaatcatgaagaataattttacaggttttccatccaaggcatcaaaatccaccccattactacttttagcaaataacaccgctgcctcattaacagcattagtcttagcatgaggcatcgcaatctcgtcaccgataccagttgttgattcagcttcacgatctagaatacctttaagataggtcgcacgatcggtaacaattccttcactaacgtatttatcaatcatttcgttaatcgcatccgattttgaatctgcttttagatccataatcattaagtttttcttgagtaaatctttaatctccataattttaccccttacttttcaaagacatcaatttcgttaaaaatctcgtcaatttttttattagttgcaatatccagtgaaaatgctgtggcacttccacacgctaaaccttttttaaaggctttttctaaatcatgtgactgattgaattctccaacaaatccagccaacattgagtccccagctcctacagaatttaagactttgccttttggagcaaaacttctaagcacacgatccttggaaactagcattccaccttcaccagccattgaaatcatgacattttgagcgcccatttcaattaactttttagcatacttctcaatatctgcatcggtggttacttccgtatgaaataattctccaagttcatggttatttggcttgataacgattggattattttctaaggtatctaatagaccctgtcccgtagtatcaactgcaaattgcgccccatttgccttaatttttttaattatttgatcataaaggttctgaggtaaattggctgggatacttcctgaaaatacaacaacatctccattgccaatttgattaaatttgtcgataaaacttgctaattctgtatcatcaatattaggcccgagggcatttaattctgtttcttgttgagcatgaatttttacattaatcctagtatcttctttaatctcaacaaaatcggtttgcacattcaaccttgttaatacatcattcacaaatttcccagtaaatcctcctagaaaacctaacgctgtgttagacacatttaattcatttaaaattcttgaaacattaatcccttttccacctggaaatttacttgatgtcttcaagcgattaaccaagccaactttcatttcatccagactgattacataatcaatcgatgggttaagtgtaactgtgtaaatcatttttgaacctccatataatatatattttcctctgctttgagccattctggacaatggtcggcaataattgttgcatcttgcaattctgcaaaacgtacaaatgaagtcttattaaacttagagctatctgctaaaacataagcatttcgacttcttttaatcacttctgacttaatctgggcttcttgaatatctggagtggtaaatcctaattcttgggataccccattggttcccatgaaacatcgatcaaattgaaatgttcgaatccgatccgttacctctgatccaatcaaagcccgggttttattttttaattggccaccaactagatacgcattgatatcaaaatctgacagtaatccagcaatcgtcaatccattggttacaactaacagtccctcgatttctgccaagtatggaatgatcgttgcagtggaagttccggcatccagaaaaataatctccccactttgaaccagttctgcagcttgtcgcccaatttcatttttttctaatagattcattttcgatttaacttgaaaatccgtttcggtttgaagcccattttcaagttgagctccaccatgaacacggactaactttccttctgcttcaagtttttttaaatctcgacgaaccgtagaaattgatgattgatttgcatgcataatttcatcaactttgataacttgtttctctcttaataaacgtaaaatatttcgttctcgaagttctgtaagcactttcatcaacctccatagaagaatataccatcattttagttcaaaatcaatcaaattaattcaaaaaaattcaatttcgttcattttacatcaaaaaaagacgcctatcacttgatagacgacttctaaattattcaatttcactttcaataacttctttagggtttctaggatgatgctgctttaattgaattcctaataaatcaatgaagaaagcgacggtaggaataccaacaatcaaccccccaagttcccaacatttttgctccaataattaaagtaatgaaggttacaaagaccggcaaatcagtggcacccgccatcaaccttgggtgtagaaagtatgattcaaaaaagtgtatcaatattactaaacaaagcacttctgcaattgagataataccattggccgaaaaagcaacaattgacaaggggattaatgaaattaaaactccagcaacggggactaaacctagaataaagacaataatagccattaatagcagtttaggcaccccaattatccataaaccaatcaccatcaaaccggtattgataatacaaattactaattgggtttcaattaccgtacctagtatcactacgtacttacgaagtaagtagtatacatttccgaacatgatatcatacttactctttaaaatagcatgcccaaattcacgtaaatggttgtaagttaaattaaataccatacttagaaataacgcaattataacgtgttctgcagcgatcccgattctgccaagctgatttaacccagacattgcgatgtattgacttcctttcaccgcttgtgagtttctatttatctcagtaaggattgtttgaacatagtggttactaaacgtatcactgtcaatagcatgtttaattaaagaaggaattccttttaattgatcgtaaatcatcgaggccgtaaaagaaaaaacaaagcccgcaaaggccagtaaaacaatataaaaaattattgtaccaattggctgactaaccttggtgtattttctaatcttttgaattcccacgtgtgacacaaaggaaaaaattactaccaataaaatttgcgacataaaatctcttaataaaaatattatcaatattagcgctactagcgttgcccaaagttgaacagattttttatgccattgttgaactaatatatccattgaattcctccaaataaaaagacctgcacaaattataatctgcaacagatcttaatcgaaaatttaaaaagttatttaacacttatttaattatttttggcttttaaataatggagcaagtggttcattatcataaatcatcttaattgcatttcctaaaagtggccctacagataattcaactaacttatcaaatttcttatcagcatcaattctaattgaatcagtaacaatgattttagacaatttggattcttgtaaaattttaggtgcattattagaaaagattgcatgagttgcagcaccatatacctcagttgctcctgcgttatggagggcttccgctgaaatcgtcaagcgtgttcctgtgtcaatcatatcatcgacaaccaaagcaattttatttttaacatttccaatgatttcagtcggaatttcattaatactttctacagattcttcattacgattatcaataattgcaatgggtgtgcctaataattcagccatggttctagctctagaaacactagcgtgatcaggtgaaactacaaccatattttcgacatcaaaactcccatcactaaaataacttgctaacaatggagcagcggcaagatggtcaactggaacatcgaaaaatccttgaatttgtggagcatgtaaatccagcgtcagaacacgagtaattgcatcatcttccaaaaggttagcaatcaatttagctgtaattggttcccgtgaacgagctttgcgatcctgtctagagtatccataatatggaataacaacattaatttggctagcactagcacgacgcaaagcatcaaccataattaataattccatcaatgaatcattaatagggtctgaaatggattgaattacataaacttcatccccgcgaatactttcttcaatatttacttggatttcgccatcactaaattgcttaatagcagcttttcctaaaggcattcccacctctgcagcaattttttcagataaagcatgatttgaattcaaggagaatattttcattcttctttttgttttactttcttccacagctgaacctccaattattatctacctatcattatagacaacttaggctacacacttcaagatattaactaaataaaatcatacggggtgaccccttccattccaatcattggatctacctgttctttttgaaccatcgacgtagttaaatactttggttgctctacttccactggttctgacgttgattgctcttgatcaactggttctgatacttgtatttgttttactttttcagctaaaacttctgcttgcggattaattcgacgttctaaactggtatttcgattagatgattcattgcttaccgctctttggtaagcatcaggttcacccaacaaaataatcgaattggacgcacgagttagccctgtatataagaggttgcgttgtaacattcgatagtattgatgcaccataggcataatcaccaccggaaattcactaccttgtgatttatgaatcgaaatacaatatgccaaggtcaattgtccaaggtcagttttagcatacgtaacttcatttccatcatagtcaacgactagatgagctctacctttgccttgcttttccgtaacaattccggtaatttcaccaatatcaccattaaagatattattttcaggcgaattaaccaattgcaaaactttatcaccaattctaaaagtttgattgccagattcaatttttttcggtttatccgtttgaggtggatttaaaactttttgtagatgtcggttaatttcatctactcctgcactacctcgatacatcggtgctaaaacttggatatcattcttagaaatccctttatctacagccttttgagcaatttgatcaatcgcatcggcaatttgattagcgttagctagaaagaaggatttatcttttttatttttgataaaatcttcaggtagtacccctttttgaatgtcgtgggctaactgaataatcgatgaatcttgttcttgacgataaatttttgtcaatgaaatggttggaattttaccacttttaattaaatcattaaatatttgtcctggtccaactgatggtaattggtctttatctcctaccaataccacttgcatatctggattaatggcattaaccaacgtactaaataatccagtatcaaccatagacatctcgtcgataactaacaaatcgccttcaagctgctttatttcatcattctggagatcgtcattaccatttaaccctagcaaacgatgaatagttttagctggtacattcgtaacttggcttaatcttttagctgctcgaccagttggggctgctaactgaatggggaatttactttccgtgtattcgttaatatccaacgaaatatcatttaattctgcaaagctattaattaaccccttaacaattgtagtcttccctgtccctgggccaccagtaataattgtcatagggtgtgaaagtgcaagttcaatcgctgcattctgcgtatcatcatactttaaatttagattcttttcagcggctttgattgcccgcttaatacctttaacgttcgaattcgattcaccgaccatgcgtttaacgttataactaatagcgacctcagcattatataaccatttcagataaatttggccgtcctcacctacgacttttccatctttacctagctgtaaaacttgatctgcaatagcttcagcatttacagccgtacctaaaagctttcgggcttcttggagtagcatatctgccaaaatataggtatcacctgtggcattacaccaagttttaattgcttctaagattcctgcttgaattcgtttttcaaaatccggtttaatatttaagctagcagcgatagcatcagctcgtttaaaaccaatattttcgatatcctcgaccaatcggtagggattctcttcaatgatgttaattgcatcctcatggtatttatttacgatactactagcaatttttcctgtaatccccatatcactgagctttataagaatatcctctaatccattggactggtccaaaaccgatacaatcatatcaatttgcttttctttaaggtttagaccgtttaaaactccagggtctttcttaatttcattaagtgcatccgatcccaaagcttcaacaattttttcagcggttttcgttccaattcctttgaattgtgatcccgacaaatatgtaacaacaccatcttctgtatttggcataaacgctcgatattgattagcttgaatttgcataccatacttaggatgtgcaattagttttccattaaattgatacttctgtccttcttgtacgtcaccaatatttccagtaacaacaatctgctcttcggaccagtcaaaatcatcttcttctacagtaaccaggagcactttaaataaactatctgggctctcaaaaaagaccgcactaatttcaccaatcagttcgaccatcttattttgagactgcttttttgggtcagcatcgccaaataaattcattttctcaaatgccattaaacatcttccttatattcacttagtaatttatcgatatcaattaatcgttgtttgctactttcaaaatacgttttatcaattttttttgcttgttcaaaataaatgtttgttttctttttagttaacgtcatttcaactacgccacggttaaatagtaacttagctgtatttttattttctaacgccgtatcataatacttttgggcccttggagcatcccctagggctaaattaacatcacccattaattcatttgtatcagcatcgtggggattctgttctaacgcagttagtccaaaagcaaaagctaatttgtactgactttgagcatagtaaccctgagcaatcattaaattagcatctttttttagatgtgcatctttaatagtttgaaattctacattagccttctcatagagtccagattcataataaacattccccaaaccgtatgttaataaatcgacgctatgcgaatctttaaataaacctcgagcttttactaaaagttcttcagcttggtcaaaactttgttgtttaaccaaaaccgtagctaacgcataataattttcagcttcttgcggattttgatcgattctatcaatcaaatctttaactatatcttgttttttcttatcttcagtcattttttcacctacattaaattacatctgttgggtcgatgcgcttctttaagtaactagtattattccaatcaactaattcaaaagactttcctaagtcattacttgctaggacagtcgtactcgtattggctaaaccgccacgtttccttaaatcagctaacggaacctctaatagtgaattaattagagcatttaaagccgctccatggcttactataattacattatcatttttagcaggatacttttcacaaatacgcaaaatagtaggtttcatacgttttactaaatgttgaaaagtttctcccttaattttggtaggatcataccgatctgggtggtttctgaatgcatccacttcatctgtatattctcgctcaacatcgacgaatttcattccttccataatacctagattgaactcttttaacctactagaaatagtaattggcgttggataaccttgtaattcatccaactcatgttgtaatgtcgtagctgttactctagcacgtcgtaaaggactggcataaatatgttgaaatttattaggtgcaagaaaactagctaattgtgaaatttccgtgtagctttctttcaatagtggagaatcaccattggcaccttgatagcgtccctctaaattccattctgttttaccgtgtctaataaaatataatttcgtcaaaattcttgtccttcttttacatagttactaataattttaacattaaatgaatcctaggttaccaaaaaacaaaaaaagaaccagactaagtctgattctttttaaattagatgtattgtaacatcttcttttcactattgtatgcagcatcaatgattccgccaccaatacattcctcaccatcgtaaagcacaagtgcttgtccaggagtaattgcacgagctggatcatcaaaatctactgtaacttttgaaaagtcttcactaaaatgaactgttacaggtacatcttgcgcacgataacggaacttagctgtacagcggaaatcacggcctcgttcttcacctaatttattcacaaaatgcatgtcagatgcatccaaactagcagcataaagatgactgttttcaaaaccttgtccaacgtacaagatattcttagaaagatccttaccaactacaaaccaaggctcgttattcttagatccaccaccgataccaagtccacgacgttgtccaatagtatagtacattaagcccgcatgctcaccctttacttcaccatcgagtgtcatcatcttaccagccttagctggaagataatttcctaagaattcgcggaaatttttctcaccgataaagcaaataccgacagaatccttcttatcataaactgatagtccagcttcttcagcaaccttacgaacctcaggcttaatcattccaccaagtgggaacattactcgatctaactgttcagcacttaattgacttaagaagtatgtttgatccttattgctatctgtagctcgaaggagatgttggtgaccattctcatcacgctcaacttgggcataatgtccagtagctacataatccgcacctaaactaatcgcatagtcaaggaaagctttaaacttaatttcattattacaaataacatcaggatttggtgtacgtccttttttgtattcatctaagaaataagtaaacactcggtcccaatattccttctcaaagttaacagaataataaggaataccaatcttagctgcaacttttgcaacatctttataatcttcggtagctgtacaatacccattttcatcagtatcatcccagtttttcatgaaaacacctactacatcgtatccctgctgctttagcaagtatgcaactacagatgaatccacaccaccactcataccaacaacgacacgtgtcttactgttgtcagtcatatttatcaccatcatttctatcagattctggagaatctacgattgaaggtcgcataaatccagtaaaatccattttataccaaacacttattaaattccaccattaacaaaaagttagtaactattttttagccaatacttctctttcaagtaattcttgaatcaaaaaatggtactgttcaactaatggtgcatcctgttctcgactaaaaatgttaacactttgcattccattagccgtggttgtactcattttaaatccagagaaatctggtttaatcattatctttaatttaatcccttggttaaagggtgaagttgaatctaacgaacgttctaaaacgaatgttccattattcttagtcgtgaatcctaagtctaataaagtatatttttttatattagcatttaacgtgtaaatgacattatcacccttaacattcacttctttagtaaaagccatctgaacccctcgcttctatttattgcttatttgttttaatcgttgttcaattgctacaatctgatcacacagatactcaatatcttcttccgtagtctttttaccgaagctaattcgaatcgattcactaatacgaggcgaatcctcaccatacatcgccgtcaatacatgtgatggttctaagcttccagcggtacaagctgatccacctgatatagcgattccggcaagatcaaggttagtttgcattacgtaagttgaaactcccttcaaccaaatgttgaaaacatgttggaggttgttctcatctaacgaaccattgatttcaaattcagtttcattttcttttaaagtttgaatgattttttgcttaaaaccggcataacgagcctgcaattgattcttttggtctgcatcaagcaaactaacagccttagcaaatccagcaatattggcaacattttctgtacctgcacgccgcttgtcttcttgttcgccgcctaatataaagctatcgaaattaacttcgttgttcttatacaagaagcccatcatttttggaccgttcaacttgtgggctgaagttgataataaatcaatgtggtcacgcttaacatcaatatctactaacccgtaggcttgtactgcatcggtatgcaatactgcttgatgatttttcaatatttcaccaatttcatgaattggcatatggctaccaacttcattgttaccagtcataatacttactaagattgtttggtcatctagcgcatttttaaattcatccaaactaatcaatccattttgatcgacccctaaataagtaacttcaaatcccatactttctaaacgacgcatggggttcaaaactgatggatgttcaattgcagtagtaataatttttttacctttatcttgattacgtaaagcgacttgtgtaatagcagtgttattactctccgtgccaccactagtaaagataatttcatcatcattcgcatgaatactttgtgcgattatatgcctagcttcgtcaagtgtagctcgagctcgacgaccgaagccatgtaaactagatgcattaccccagttatttaataattcattagatattacttcaactaccgcggcatccgttggcgttgtagctgcattatctaaatatacttgttgcattatttattcccttccatcttaaataaatcaatcagcattgatgcggagcgctttccagcgtcaataataaattcatcaaaagaaacattcgcatcatcactaccggtatcagacatagcacgtaccacaataaatggtttgtcaaattgatgagccacctgtccgactgccgcaccttccatttcacaacataaagcatctggaaagttttttagaatagttttaactttatcagcactagcaataaattgatcaccagtaacaattagacctttttttgtatttaaattacgattctgagctgctaattcaaattgatgaattaataacgcatcagccttaaatctagcactgtcttgttgtgggagttgaccatattcatagccaaatgctgttgcatctacgtcgtggtacgccacttcagttgatagcaccacgtctccaacttctagtccttccccaattccgcctgcagaacctgaatgaattaaggcatctgcgttaaaattggtaactaaaattgctgctgtaattccagcctcaactttaccgattcccgaacgcactagaactacatctacattactaatttttccttcataaaaaacgattccattgatattggtttctttttcaagttctagcgtgtcaagaagcgtcttaatttcttcttccatggcacaaattacaccatatttcatactttattcacctatcctacaaaaaataaaattaagaaaactaatatgattccaattcctaatcctgctattgcgatgtttaacttcttagccaatgcccggctttttgcttccgactgttcgtctggattgaaacgctgatctttagtctcacgctgttttctttggctacgtgataattcttcatctacagtttgctctgcatctatttgttctgtttctttttgcaaactcctttgatattcagcacgagtttgttttttcttatccaaagcctcacctacttaatgttagccttccaataataaatggctaaaattgtttttgcatcttcaattttaccttcagcgacagcttttaatgcctcatccaatgaaagttcaaaaatatttaagttttcaccttgatcacgaggaagttccttagtgactttctttaaattggttgctttatacaaagtcatatattcatttgaaaagcctggagcagaataaaaaccattaattttttcaatcttctcagcttcatagcgggtttcttcgttcaactctcgtttggctgtctcaagtaaatcttcacccggttcaactttaccagctgggatttcaattgttaacttgccaattggtgtacgccattgttcttcaaagattgccttaccgtcatcggttaaggctaaaactcccactgctccttggtgtttaacaacatctcgattagccaattcgccgtctggtaatttcaccgtttgttgataaacatcaataacttcgcctttatatcttgaaatagactctactactttttcttcaaaactcattattattcaacctcctcacgaaaaactttaaccgcgattaatccttttggcccatctgcaagcattaacttaaccttttcaccgacttctaaagttttataatcttcagattgaatgaccgtgtagtgcgcgaatactttatctccactagctgtttcaataaatccataccctttttctttatcaaagctttctactgttccagtttccaaaatttcagctccctttttatgtttgtcatactaccatcataatggtggaaaacacttctgtaaattaaaaatgattaggttactcgcctaatcattcttaattaattatttttcttcaaatccttcagtaattgtttcagggtaattttcagtaacgatttgggcacaactagcacatagcgtagcaaagtgttcgtctgaaccaacatcagtttttgtcattcggcaacgttcgcaaacttccccttgagcaggtgtaatttcgactgctaattgatcgtcaaaaattgctgtatcttttggagcttctgataatgcctttacttctaattgtgaaacaatcaaaatcaaacgtaaatcaacccctaatgtatctactaattgcttagtggattcatctaggtataaggtagccttagcttccattgatttaccaatcattttactatcgcgagcttcttcaagcgcctttaatacatgtgagcgcagttccttaatactttgccatttacttagtaaatctgcaccatccgtatagttagcaacttccggcatttcagctaattgaacaaattcttctggttcacgaaggtattcccaaatttcttctgctgtatgtggcaaaattggtgtaattagttttgttaacccaaccagaattttgtagaaaacagtttgcatagaacgacgtttcaaactattttcaggttcaatataaacgacatctttagcgaagtctaaatagaatgcagataaatccgtaataacataattcaacaatgttttgtagatgtcgataaagtcatagttatcatatgaagtacgaatcttactaattaattcattgaactgaactagcatataacggtcttctggacgcaattcattataatctacgccattttcctttggatcaaaatcagatgtatttgcaagtaagtagcgaacggtattgcgaatcttcttatatgattcagaggcctttacaaagttttcttgagaaactcggacgtctgatgaagaatcaattgaagaaacccagagacgaatgatttcagcacccatcttcttattaatttcatcaggaacaatggtattaccaagtgatttactcatcttatggcccttaccatctaaagtaaatccttgtgaaataacttttttataaggagccttgcctgatacagccacgcttgtaatcaaactagaattgaaccaaccacggtactgatcagaaccttccaataccaagtcagctgggtattcaagataatcgcgttgtgccaaaactccttgatgagatgaccctgaatcaaaccaaacatccataatatcattttctttagtaaactcgccatttggtgaatgctcgttggagtagccttctggaagaagatcctttgcttcccattggaaccaaatatccgaaccattcttctcgaataaatctgcaacgtgattaatcgtttctttttcaagaattggtgtaccatcttcagcatagaaaattggcaaaggaactccccaaacacgttgacgagagataacccaatcaccacggtcccgaatcatattgtgaagccgcttttgaccccagtcaggaagaaattcaacatcttcaatagcttccaaaatctgatcacgaatcttatctacagatgcaaaccattgaggcgttgcgcggaaaatgattggtttcttagtccgccaatcaaatggataactatgcacatagtccatttgttttaataaagcattagaagcttttaatttgtccaatgcaattgcattagcatcttcataaaagacaccttcaaaatctggtccagcttcagctgtcatgtagccacgatcatctactggtacaaaaatatctaatccatattccttacctacacggaagtcatcttcaccaaaacctggtgcagtatgaactaacccagttccagaatccaaagtaacaaaatcacctaacataacaactagttcgcgatcgttatcaaatggatggatagccttgatacggtctaattcacggccacggataacttgaagggtttgaacatcttcccaaccaaattgttccgcagcataatttaaacgatctgtagcaatcacaaatttacgatcttcaccggctggttgaacaactgaataatcaaaaccagcatcaatcgtaattccttctgaagctgggattgtccaaggtgtcgttgtccaaactacaaaataagtgttttcatcaagaacgccttttccgtcactaactttttctgcgtaaaatgcagatggtgaagtaacatcatgatattctacttctgcttcggccatcgctgattcagatgaccatgaccagaataccggcttcttaccacggtaaattaatccaagctcggccattcgaccaaatgttctaatttcttgtgcttcaaattccggattaagtgtcaaatatggatgatcccattcagcagaaatacctaaacgtttaaaatcagtacgttgtttatcaacctgttttaacgcatattcatgacatagctttctaaaatcagctgtagacattttttttctgtcatagccttccttagtaagctgttgttcaattggaagtccatgggtatcccagccgggaacgaacgggcttctaaaaccactcattgacttgtaacgaacaataatatcttttgaaatcttattcatggcgtgtcccatatgaatatttccatttgcatatggaggcccatcatgtaaaacgaaggatggtttgccttcatttaatttttgacgttgttcataaattttattttcagcccagatatcttcacgtttttgctcattaactggaagatttccacgcattttaaattttgtttttccaaggtttaatgtatctttaactcgcactaaaaccactcgcctttccaagtaaaataaaaagactccatcccttaacagggacgaaatcttcgcggtaccacccaaatttaaagaccattaaatggtctttctctttgtagcacttaacggttgccaaccgactagatttactgaatttcaatctagcactcaaaagtgatcaaccttcaaattacatactgacctcccaccgtcgtcagctcgctaagatgctacattttgaagattcttcttttttaacgttttattcttttggtttaacatggaatccttcactagttggattaccattctcattattgtagtcttctgggaaaactacaacggtttgttgatcatcttgtacttcaggttcaactgctggagtatctggagtaacttcgacaacttcttctgagtgtacactctcatcttggaagttgtcaagcgtaccactattacgcatggcttctttaatttcaccaatggtgagtagttcatctgaactaagcagattatcccagtcacgtcccttaatcatttgaagttgtgactctagtaaaacttcaaatttttgacggaaactacgagcttgcttcttcaaatcatcagtagcaattacaaccttttgagctttaccagccgcttcaccgatgtaactatcagctttcttatgagccgcatcaattactgacttagcctctttctgggcttctttagaagtaaattcggcttcgcgttttgaactgattttgactttatcagctgcatcttgtgccaccataattgacttattgagggattctttcatctcatcaaaataatcaattcgacttttagcctcgttaagttgtgaacgaagtgtatcgatttcatcatgaagacgacgctgttcaaacgcaacttcgtctaaaaattcatcaacttcgactggattgtatcctcgcattttatttgaaaattgtttttgttgtatatcttgtggttcaattgacattttaataaaacccccataactcactatctagttttgattatatccagctggatcttaagtttatctttttttgtttttccaagaatatcaacaagttttatcctaccatattttcgaactgaaataacatcatttaacgcaattaaagtatcagctttctcatcaatcatccaatttaattgaactaaacgtttttcaatcagttctttcactcgatgacgagagatcgaaaatcctgttgaaataattgaatccattcttaaagatgctacagtctggttaacaggctcccaatcatcttgaacttttaaaatatcatttgttgaagtaggaatcaatttaacttttattttaccaattcgatcaatttcatttaaaaagaaattttctaattctccattaacagcaaattgccagcattctgcttgatgaactatatcaccaaaagtacttcgtttaataccagcattaaccaatgttcctaaaatctgacgatgttctaaatctgtaaaattaattggataattaatttcaaagattctaacagaaaaatcatcttccgcaggaacaaaataatctggtgtaatcaatgctcgcttattttctgcctcgctaaagcctccattaaaataaacctttagttcaggaaatcgattaactagggtttggagaatatgttgttctcggggatttaaaaaattagttaaaattggacgattttgatctaaagcctcttgtagtgaagatgaaaagctctcaattaattcctgctcttcttttctaaaatgctgtgtaatttgattatccatagttaaattacaccaagcattaaggtttcaagaaaaactaatccatttgcacacagttcaagaactaacaaagctaatatcggcgaaaaatctattccaaagataggtggaataaatctaaaccaactcatataaggctgacaaattttagtaagcaactttcccaagccggattgataagctcctggaagccaagacatcaaaacccacacaaagattgctaacatatacaattgaatggcccaatgtaacaattggaagattactgtaatcattattttctatcactcatttcaatattttgtcctaattgcaataaacgggcttgagcttagcccaaacccttttattatattttatttgccgcgacgtttgaaaaatggaggtgtatccaatgaatcatcgtcagagctaatgttgttattatcgttaaaagcgttgaattctttcttttcaacatttctaaaactatcgttatcgcgtgaagtaggacgaaccccatttgaagcatttgattgacgtaattgccagtcaccaaatggatcatcagcagcttgagtaggttgttcactattagatgacgtgtttaaactttctgtagaaccagcaccgcgaatttcagtattatttgaaacatttgttgtagcagtatttacgctactgcttggtgtttcaaaagaggtgcgtgctggttgacggtgtaaagacgctctaccagcttttttatcaatacctgtagcaattacagttactcgtaccccatcttgtaaatcattatcaatagaagtaccgaagatgatatttacatcatcattagctgcttccgtaacaatttgtgaagctgcttgtgcttcaaataatgaaaggtctggaccaccagtaatattaagaagaacttgttcagcaccatcaattgaagtttcaagcaatggcgatgaaatagccttctttgtagcctcttctgttctgttttcgccgctagctgagccaattcccataagagctgagccttgattttgcataactgtcttaacatcagcgaagtccaagttaacgtagccaggtgatgtaatcaaatcagagataccttgaacaccttgacgtaatacattatcagcttcgttaaatgcttccatcattggagtttttttatcaactaaatctagtaagcggttattagcaatgataataagcgtatcaacatgttctttaagatttgcaacaccttctgctgcaaatcgagcacgtttaggtccttcaaatgtaaatggacgtgttaccacacccaccgttaaagcaccttgctctttggcaatttgagctaccataggtgcagcacctgtaccggtaccaccacccattcctgctgtaacaaaaatcatatctgctccttcaagagcagaggaaatggtttgttgactttcttcagcagccttagcaccaacatcaggtgttgaaccggctcctagacctttagttaacttaggtcctaattgaatcttaacgtctgcgtttgaagcttgtaaagcttgaacgtcagtgttagcaacgataaattctactccctttacgccttcagcgatcatgcggttaacggcattcccaccaccgccaccaacaccaattaccttgatgtttgcgcctgtacttttactttcgtccattgaaaattccatgttaattcctccatcgattagttagtcaaagaaatcactaaaccattttttgataccatcgaagcgatttgagtttgctgtgcttgatgatgaattattagttgttggcttaggccgttcttgttgtggttcgggacgtctctctgatgattttgtgcgttgtttaaatttaggcttttcatcaacaacatcatcttgcggtgtttctgatacggttctttcgcttgaaaccattgctgttttagctaaaatctcaacatcgctcatgcgaccttcataattcaaaatagcaagagcttgcgcaaaagcaggatgtcttagacccatttgatctggaacatatagtttagcatttgtttcaaaaattctttcaactaacgtttcgattccaggaagggcagctcccccgccggtaatgacgacaccacccggcatatccagagcccctactttttctaattgtttttttatgttagttaatatttgttccattcgagcttcaataatttcacttaaatatttctcagtaactgcaaccggttcattttgaccaacaacatttactggaaatgcatcactacttgcttgatcagcaacagcataaccatactgttgtttaatttgttctgcattatctaacgaagtatttaatactaccgagatatctttagttacaaattgtccgccttcttgttcaacgaacgtgtacttaagatgatgatcatggatcacagcggcagttgattgtcctgcacccaaatcaagggtaatcgtaccaaaatcttgttcaccatcatttaaaattgttctgccaagagccagtggactaacgactacatctactaatcctaaaccagcttgacggattgcgctctttaaattatgaataatggtcttaggaccagtaatcaatcccccattcatctcaagtcgaacaccgaccattccacgagggtctttaatgccatcaaaaccatcaacgataaattcgtcaggtaaaacatcaaccacttcctgttcgggaggaagattatgtactgaagctgcatttgaaacttcaactacatcttgatttccaatctcccttgagctatctgagatagctatcatacctctgacaggttctattcttaataaattagctggaataccagctactacgtcgtggatttgaatatttgccttgcgttctgcagactcaacggcccttttaattgcaattgaggctttgtcgatatcaacaataacaccacgatttacaccatctgagggctctcttcccacaccaataacgttcatttgtcctttgacatattcagcaacaataacttttattgaggtggttccaatatccagtccaacgtaaattcctgaattatccataataaaggaacctcctagtcgtttaaccgtttcttatatatatattcatcacatatattaaacagtttaccatattaatatcaattcttgtataaaaataggaaatacttattcataaacaattattttttttaatcagctccaaaactgatagtttttcaattaaaaaacttattctaacgcaaccaatagcacttaaaaatcgtttgaccctttagtggattaaacgatttttatctaagagcatcttatccatcttaagtttcaatttgatgttaagaataaattaacagatttattaatctatatcttgttgagtatttactgtactttcagcatttgagctttctaagtcttctttactttgtgagcttgctgaattaattgtttcggttgaatctgctgaaccactggtagaatcggcactttcactattttgtgtcgttttttcctgctttttagctttgctactagattcggcacttttagacgattcactggctgctttagcctcatctgtccaaccgctaggtctagaaaaagctcctacttgtaaatcaaccattccccgttctttcatacttgctgaaatttcggggtaatacttcatttttttagcaaatgtactcataatagcgtacacttgatttccatcattcatgaaaaaatgtagacgatccttaacatttttagtcggtgaaaaatcgacttctgctacatcattttgaacactatttggcatctgggcatattccttcaaaaactttttaagtgtactattttcttggaaatttctgaagattgggtaatccgaacttggttgactaacactcttcctaacaaccgaaccatcttgttttacggtgtaataagtcttgtttcttattacatatcccatgaccgcgttttctttaactttaattttaactttgccactccatgaaatggatacggtagcatctttgatgtctgtatttttctttaaaagattattttcaaattttccttccttaaatacggaagttaaaattacatcattttttttgatagacacattttttaaaattttagcagtggaaacacgcttattaccgcttacactaaatttttgaactcgactaattgaagaataaaaataaccaaaaaataaggcgatcactatcaacgtacttccaattaatattcccagtttttgtctggaaagccgttgttcttttactattcttttggtgccttttttatttgattttttaaccttgtttcgattatttcttctaaaagaagcttgaggttcgcgtggatttttcgaagtggctttgcgtttccgcttaaatctgcttctactatttgcattatgttctttttgatatttggcccacggagttaattcttcatccttcttctttttcatcttactacctatatctacttactaaccgatttcaaaacatcataaagattttcagcagcacgtggttgacccattttcttagcgttttctgccattacgtttcgaaatttctgatctagcatcaatgtatcaagcgtattaatcaatgcttcggaagtaagatcactttctttgataatctctgctgcatcattattaaccagactcattgcattttttgtttgatgatcattggttacatatgggctaggaattaaaattgacggtattcctaaagaagtaatttctgctaaactagttgctccagctcgccccacaattacttccatattggaaagaatttctggcatatttgcaatgtaaggtaaaatagctattttgccttgatatttagccaaatcaatatctttggttaaacgttcgaaatgaactcttcctgttacaaatattgtttgatatggacgttccattaattcttccaaggtgtcgatagtgacctgattaatcttctcagctccacggcttccaccaaaaatcaatacggtaggcaccttatcgtctagagcaaattgacttagtccacttggtttaatctgtgctacttcagtagcgcgaggattaccagttaacacaactttcttggtaggaaattgacttgcagccgcctcaaacgaaatagcaatttttttaacgaacttactcaaaaacttgttggtaacgccaaccacactattttgttcgtgaatcacagtaggtacacccatcatactagctgcaaatacaaccgcaccactaacgtagcctcccgttcccaagactacatctggtttaaattccttaaccatcttacgcgctttaaccacgctacttaagaaaagtccgattgtcttaaaattttcaagtgaaagtgaacgtttgaatccttggatatttatggttttaaaatcaattccactgtctgggacaattttactttctaatcccttacttgtaccaacgtacaaaatctgtgaatcaggttcactttgtttaacttgtttaatcagtgctagggctggataaatatgtccaccagttccaccaccagaaaccatcagtctcatttaattattcccctttatgtaaattttgaactgctgcaataaattcgtcaccacgttcttcaaatgttttgtattgatcccaactagccgctgccggtgaaagtaagataatatccccttctttactatcttgatacgctatttcaaccgattcacttactctagaactatctttaattactgaaataccggctttttgagctatttttttgaatttctcagcagtttcgccattaacaataacttcttttacatttggctctaagtctggaattaaacgatctaaatcgtcatgtcggtctaatccacctgcaattaatatcactggttttttaaaagaacgtaaggctacttgggtagcttcgatatcagttgctttagaatcattatagaattgacgcccattgaggttttcaacatattgaattcgatgttttactccaccaaaagttgtcaaaacttgtttaatatgagctgtgctgactttttcgattttagctactgcgatagcggctagtgcattttcgacattttgttcaccaggaattccaatttcatcggcttccataattaattcatctttaaaataaagtttgccttcaatttcgtacgcaccgctcttagtcagtccttgacgtgaaaacggaactactttcgcctgagttcttttagctaattcttgccattcagtattatcccaattgattaccaagaaatcgtccttggtctgattcttagtaatattcatcttgtcattaacgtaattttcacgtgttttatgccagtctaagtgactagcaaaaatgttattcaaaactgcaatatgtggatgaagtcgatcaataccagctaacataaagctagataattccatcactattttatcttctgcagtggccttttgagcaactgttgtagcaggaactccaatatttccggcaacataagcatgttttttattatcgtcaagcatcaattgaattagcgttgttacggttgttttcccattacttcctgtaaccccgatcaactcactatccattacccagtatgctaattcaggttcagaaacaatttttatacctctggcttgtgcgtcgactagaacgggatttgtataaggaatgcccggatttttaacaatcaactcaattttattttgacttaaaatattggctggatgttcccctagtaccatccggatacctttgttctcaagcttttcaattaattcttgtggctgattagcgttagcatcattaactaaaacatttgctcttaatctatgtaataaaagagcggcgcttactccgctcttggccattcctaaaactagaacatttttatcttccaaatcttctactgacttcatcattaaagactccctataaaatactaattaacgtaattatggatccgattaaaccaactatccaaaatacaatatctactttccattcgttccaacctaacatttcaaaatgatgatgaatcggactcattttaaaaatacgatgtccagttaatttaaaagaaagtacttggagaataacacttaaagtttctagtacaaaaacaatcccgattaaaatcaatgataattcctgatttaaaagaattgagacagctgccaaagctccccctaaggcaagagatcccatatcacccataaaaattttagctggtttatggttaaaaactaagaatcctagcattgagcccactactgccatacagaaaaccattactggaatattttgttggtgagctgcaataattgcatacgttccaaaagcaatcgtcgataatcctgctactaatccatctaatccatctgaaagatttacggcattggaaaatccagttaaccagaaaataacaaacaatgcataccagccgcctaggtgccaaatacctaagccagggatatttaattgtaatgccactccagtctccttaatcactagaaagaaaattagtcctccaataatttgtcctaaaagcttttgccaagctttaaaaccttcattttggcgctttaacaacttaatactatcatcccagcaaccaatcaatccaaattcaactaaaacaaaaagtaacattaaaaggctcacttttgccccgtggaaaatcacaccagttactaaactagcaataatgatagcaatgataaacaccattccacccatggttggtgttccagattttttttgatgccatttaggtccctcttcacgaatcatctgtccttcattccggactctaaagtaattgataaattggggcatccccactaatgttactagcgcacctagtattaaagctgttccattaatcatttttctctcctaatctctacttcttaagacttacagtcatggtcatgccagattttattggaccacccttggccaccgattgcccagaaacaaaaccattcccgctatatttcacatcaatatcaaacatgttagctaattttataacatcattttttgaccaccctgtaagatcaggcatagttatggttccaccagtgtctaagataattcgttgccccactagaatactacttcctgcactctcggattgttctttaacagtttgcccatttcctaatgtaacaactgccacattcttcttacccaattcttttttggcttcagaagcatccttgccaactaaattaggtacttcaattgagctgtcgagatttgacttatcagtttccttatcctgttcaagggcttgtttcatcactggaccaaatatttcatcaagtaattgtgtggcagttttatctttgagcactggctttttcatcgtaatgtacattatgtacttaggatttttggccggggccatcccagcgactgaatacagataactgtcatcgcccattgaatatcctccgcttgcattcgcaacttgggcagtacctgttttagctgcaattttataacctttaattttgaagtttgagccgataccatatggtttatagactacatcctccattagttttcgaacctttttagcagtactagccttaattggccgtcctacatcttttgtcttcattttataagttgttttaccagtattcggatcaactacctttttgataaattgaggcttaaccatttttccattattagcaactgctgtaaaaccttgtaacatctggattgcggtcacattgattgcttgaccgaaagctgtattagcttgttcaatcggatagtcgaattgaatactacctttagattcgctttccaaaccagaattagtggattgcaacagtttaaaacgattaatgtatttcttccatgtcttagctcccatattttgttctaagtgagccatagcgacgttacttgataaggcaaatccttttgcgtaactaattacgccccacccttctgtcttccaatctggaacaactttaccatcgatggtataggttcctgaacgataagtggcatccgagtcaaaattaccactatcaatggccgcagaagtagtaaagattttcatggttgaacctggttcaaaagtatcctgaactagtgcgttattccatgctttagaaagtccttttttagttgaagcattaaaggttggtcgttgtgttgtggctaaaattactcccgttttggcattcataattgttgcgctaattgcctgtgattccgattctgattgaaccttacttaccacattttccatgatgttttgtaaacgctggtcaatagtagtatagattgtgcttccgtcgcgtgctggacgctcagtctgggatcctgggagctggtagccaaacttatctttttgcaacgattgttcaccatcagtccccgttaaagttttgttactcattttttcaattcccataacgccagaaagttgagtcgcatcattttctttttgttgagattgttgagcaaacccaatcaaatttgaagcaaaagttccattgggatataaccgagcttcagatgaaacaaagttaattccgtttaatttttctttttctattttttctttagtcgccacagaaatattgcttcccgcatttccaaattcaacttggaacgttttactattgctgggactaagagtttttaaagccttgtgatagctaattggtagatatttgctaagtactttagccgtctttttcttattggtgacatagagcggcttgttatttgctcctacctgcttcttacttacaactgcgtaaactgaatatgtacttgtgtcttcggcaatcggattgccattcgtatctaaaatagatcctcttttggctttaattgttttattatcggtatacaaacgctttgcttgactacttaagttaacactttcgacagtgccacttacggcaatataagaaaagcgcccaacaataactataaatactccaatcacaatcaataatagccatttaccaaacattttccgattgtgttgagtttccgtagtaccagttgttcgcttttttcggttcatcatttatttacattccttatattctcagagttgagagaaaggcctgcctttttagcaattttgttcaaccgactttggtcagacaattgattaatttcctgttccataatcgtatttttacttgataaggccgtcgctttctcttgagttgtttcaagattatgttgtgcagtagataatcctattttaccagaaacaactgttagcattaaccccactagaataaaaccacaaattgttatcaaaatcttttcaaattttgaaagtggtaattgcctagcagttacaacctcacgtgctctttttaattctttttcactaatgcccgtaattactgtgtcgttaattaattttgttctacggccagcataattattttgagccattggcgtctatcccttctataacttttcgataattctcagttttgcgctatgtgatcttctgttttcttcaagttcatcttcagaaggaataatcggcttcctattgatcaacttgtattttggtttcatatcatctgggataattggcagtccagccggtaaatcaccaatctcagtttgttctttaaacattctctttactaaccgatcttctaatgattggaaagtaataaccgaaatacgtcctgctggattcaaaatttgtagggcttgttccaatgattcttctaaagcacccaattcatcattaaccgcaattcgaatggcctggaaaatctttttagcaggatgtccacccgttcgccttgctgccgccgggattgcgcctttaattaaatcggctagttcaccagtagtttcaatgggcttttcttcgcgagtactttcaatttttcgagcaacttgcttagaatatttttcttctccgtatctaaagaaaattcgtactaaatcgttatagctccattcattaacaacttctctagcattcaatttttgagtttgatccatacgcatgtctaaaggagcatcaaatcgataactaaatcctcgttctgcgtcgtcaaactggggtgatgaaacgcctaaatcgtataaaacgccatcaactccatcaatccccaagtggtttaattcattctttaaattacgaaaatttgattttacaaaagtaacttgtcccttagcaacatattctgctaaatttttttgattgtaatcaattgccgtttgatcttggtcaaatgaatagaggtgaccattttctcccaacttagacaaaattagtctactatgtccaccgccacctagggtgcagtctacataaatgccatcttcttttacatctaagccgttaacggtctcttctaagagaaccgttgtatgtttaaattccgtcatatttatcacaatccaaagtcaattaaattttcggcgatatcgtcgaagttttcttcagtttcttcaatagtttcttcccagcgggctttattccatatctcaactcgattagaaacccccaccaggacacattctttttgtaattccgcatgtaatctcagttttttaggaataataattcttccttgcttatcaaaatcacattggacagcatctgcaaacataaaacgtacaaatgcacgattattcttcttattagaaggtagttgactgagcttctcctcaactagacgccattcagacaaaggatagacaaataagcatccatccagccctctcgtaacaacaaagttgctatccagttgatctcgaaatttagatggaatgattagacgtccttttgaatcaagtgaatgctcaaattcacccatgaacatgaaaccgcctccgtcaactaaatctataacaatattaccacttccccccactttccaccacttaaaacccgaatgtttttcttttatttgaaaaaaattaacatacttagaaaaagtatgaatttatcaatagttcttagccataaaagtaatcatttcgaggtggggattttttctaatttgccttaaaaatacacttattgtaaaattatcctaagtcaatcaagaaagtagtgttttgaatgtataataaaaagaaaaagaaaagcggtttacaaaaaaccatcatgatttttgtttggattatgattatcttgaccttgggaagtgtgctttacgctcctctggctcaattgtttggtgcaaattaatcagaatataaaaaaaagatttaagacagattgtcttaaatcttttttattctttttcacgatatactttacgaggtttactaccttcttgaggaccgatgataccattatcttcaagttgatccataatacgggcagcgcgattatatcccactcggaacttcctttgaagcattgaagtacttgccctttgcatatctgttactaattgaacagcttccgcataatactcatctaattccccactatcattttcttcaatttcttggtcactaatatctaaagtttcatcatagtcagcagattgttgtttcttaacaaaatcaataatctccttaacatcatgatccgaaataaatgccccttgtacacgttcaggcttgttctgacccatcggaaagaacaacatatctcctcttcctaataacttctctgctccattagcatcaatgattgttctcgaatcgattcccgacgctaccgcaaaggcaattctggatggcacattagctttaatcaaaccggtaaccacgttaacggacggacgttgtgtcgcaataatcatatgtattcctgcagcacgtgcaagctgtgccagcctaataattgcatcttcaacttcattagaagctaccatcattaaatcagaaagttcatcaactacaaccacaatatatggcatttttggacgattcatcccgtctgctgcattctgttcttcgatgaaatcattgtagcttttaatatttcgttgatttaattcagcaaacaaatcatatcgatgttgcatctctgcgaccaccttatgcagcgctttagcagcttttctagcatcggtcaccactggggttagtagatgcggaatgtcattatagattccaagttctaccttcttaggatcaattagaattaatttaacctcatctggacgagcattcattaagattccggtaataatgacattaatcatcactgattttccagaacctgtagctcccgcaattagtaaatgctgcattttaactaagttagcttctaccagattacccgaaacatcccgaccaacaggaactttaagtgggtcttctggatgggccggttgagattcaataatgtctctaaatgaaactgtcgaaattgttcgattaggaacctcaattccaattaatgactttcccggaattggagcttcaatacgaatatcttttgcggctagagctaacgctaagtcatcggccaagccaacaattttactaactttaacaccaatcgctggatgaatttcgtattccgtcacagaaggccccatcttcacgctttcaacggaagcatcaactccaaaactatttaaagtatcttgtaaaattttagtattctttttaattgaagaatattcggaactctggtctgtttgtggaatttcagttaatagttccgatgatggtaagcgataattaggattagtcttagactcactatcaaatccactattaatttctaaatcattattgttaacctgattcttaggtttacgttgaactttattagtagtcgcaatttcaatttttggttcaattggatgttcggttcctctagttccatcaacgataggttcttccaaaactttttcatccattttggtaacttcaactactggtttagatgccctgtgcattgatcgagtaacacccgttttacttgattcatttctggtttttgattgttctttttctgaaaaatctaaattgctgaaccagtcgtatacattgtttgcagcagatttaaaactagcgatcgcatgtcgtatggtccaagcaaatccaattccaattttttccaaaacctgatcaaatgggataccaaacagaactaccagccccatccccattagaataactgaaaagagcatgctccctacgctgctaagcaaaaaatgagttgcggtatataaagttgctccaccaattcctcctccaacatcatttgtagaggtttgttctagaaaggatcgttcaatgccatcaatggcccgactgataaacccattttctaatcttaagctactggcaaattgatactctacccacaataaatatcctaacaaagtcaagctaagtccaattactcgatctgttattccattaaaagacaattcttttcccatgaataaaagatacaatccatagatgaatagaataatgaataaaattgggctaagactaccaacaaagattctaaacatgttagcaactaaaattcctagaaatcctcgaccaaaataccctaatattgcaattaaaacgtaagttaaacctaaaagattttttgttggtacttgggtcttttgcttagttttacgtcttgtctttgtttttcgtttttttcttgtttttgccatatcaaatcctattttaatttatcattttcatacaaatggctcatctctaaattagggaatccttgttgacgtaacacttcataaattacaatcgccgctgaattcgacaaatttagtgcccgaatgttttcatcattttgtggaatccgtattgcacattcttcatattgccgcataaatgcttcgggtagccctgtagtttctttcccaaacaataaataattatcttcatcattattttcgctggtataatctgtttgtgagtatgcacgtttagcaaattttgaaacaacaaataatctttttttatcaggaaccgttgctaaaaattcgggtaaattttcatgatatacaatttcaactttgtcccaataatccagtcctgcacgctttaccgtcttatcattgatggtaaatcccaaaggtttaattaagtgcaaaactgtatttgtacccgcacaagtacgagcaatattaccagtattagccggcattagtggttcaaataatacaatgtgatttgtcataatttttctccaaatattttttagaattaaaaacgcagatactcggtattacgcggcgagtatctacgttcgtgaagtcaatctgcccgtttcaaacgaacatagtcgatattgcgatcaaacgatttcaactgcatattaacattactttttggtttccgcaaactccgctttaattcagtcatatccaccgatatttttcttaaatgctctaaatccatgaatgaatagaacttttagaaccgcgtaagctggaatcccaaatatcacgccaaccaaaccaaaaatctgtccagaggctagcaatacaaccaaaatagtaaccggatgaatatccaaattactacctaaaacaagcggtgaaacaaaacggccttcaattgtttgttcaattacgaagactatcaaaaccttgaccagcatgatgggcgaaacaaaagccccaattacaattgagggtaccatcgctaagaatgatcctaaatatggaattaaattgagaaaacctgcagctactcctaaggttagggcaaatttaagaccaataattgaatacccaataaagaaaattactgccacaaaaaatgccacaatcaattgtcctcggatgtactgacttaactgtgtattgatttctgttaaaatttgaatgaatccatcccggcgtttaacaggaaaaacttgtgcgataaaatgaggtaaccgatgtccatcctttaataaatagaaaagaataaacggcattgtaataatgccaataactattttggtaatcaaaccaatcacactacctaacgatgtgaccgtgttatccgcaaattcggttgccttcttactccatgattgaacagtattactaccaataccgtcaatttgtttttttaaatctcctaggcgcggatcttttaaaaatccttcgaccttctcaactcctgaattccagtagtccggccaatttttaatcaatgccgcggattgctcccgaataaccggaatgacagacacaattcctgcaataattaaaatcgtgattaagacaaagatgatcgtaattgataaaactcgtttcaatttgaatcgctgttctaatttatcaactagtggattaatcagataatataagacccccgctaaaataataggaaaacccacaattccgaaaaattcctttagtggactaaaaatccatgtgacttttgaaatcatgtataaaatcatcaaaaataataaaatgatgattaaacttaccactggcctattatctaatacaagcttattaaaccagcttctccaatacttatttcttggtttattatccactgttgttcaccgcctacatatatataatctcttctccaactttaaattctggaaattggttaggtgttaaatagattgcactttccaacggtttttcaggtaccggtttaaattccagcgttgtatgcccaatcatttgtaagttattattcactaaactaccaacaaaattaatttgatattcagttttacctatcttaattttgccaccttttttcaaagcaaatttttgatgcttttgatcatcaatcgcttgaataatcgcaatgttttttaaatccggtgttgcagtttcgtcgaataaaatggctaaagcatctttttttgaaatcgcatccggtccgacactcataatttttgctgaaatcatcaagacaaacaccctttctatattcttatttcattgtatcatatcgcatagtattatccctttagtaagcgcattcaatactaactaaatgtggtatacttgttgttaatgtttaaaagagcaaggaggactattttatgattgaatccattttattaggaacgtatacaaaacaaactagtaagggtgtttatcaaattgatttagatactgattcaaaacagttaactaatttacagttagttaccgaagttgaaaaccccacttatttagcacttagcaagaaaaatattttatatgctgttgaccgttttgataaccaaggtggcttatctgttacagatttatattcaccccaaaacgttcttcaacatatcgtaactcctggtactcctccggcttatgtcacagttgatgaaaaacatcaattcgtctttgatgcaaactatcacgaaggtactcttcatgcctatagtattaataatgatcacacactaaccctagatagtacttttactaatacgggtaaaggccctctaaaagagcaagacggttcacatttgcatcacgttgaccgcactcctgacggtaaattgattgcttgtgatttagggactgaccaagttttcgttttagattatgattcaactggttttaaaattattggcactttcaaaaccactcctggatttggcccacgccatatagttttcaataatactggtgatacagcctacctagttggtgaattatccagctcggtagcagtacttaattataaggattgccagctaacccatctccaaactattaagaccattccggatgattggaaccaacataatggttgtgcggcaattcgcattactgatgatagtcgcttcttatacgtttcaaatcgcggttatgattccattgctgtttttgaaatccaagctgatggtcaattgaaactcatccaaaatatcagtgttgaaggaagttttcctcgtgactttgctttaagtcgtgaacaaaactttttagtagtcggaaaccaaactactaataatttatctttatttgaaagaaattctaatgatggtaaactggaattgattcaaaaagacgttgcagctcctgaagttgtatgtgttcactttaaataaaaagaacggagagaattatgtttaaagaaattccagtagaaaattttactgatattccagctttaattgctaaaggtgccaatcgaattgaactttgcgataatctcgccgttggtggtaccaccgttagtaaaggtgtaatggccgaaacacaaaagtatgctagtgagcatgggatacctgtcatggcaatgattcgcccgcgtggtggtaatttcgtgtacaacgacatcgaacttaagattatggaagcagatctttttcaagcccaagagttaggagttgacggcgttgtctttggtgctcttacgtctgatggaagcttagatgaagaagcaatggaacaattgatcggtgctgcaagtggaatgcaaatcactttccatatggctttcgatgcaattcctaccgcaaaacagactgagagtattgattggctagtggaacatggagtggatcgcattcttacgcatggcggttctttaaatcaacctattgaaaaaggtttagaacaaattaaatctaatcttaagtatgctgctaatcgcattattataatgcccggtggtggcataacctcacagaatgctgaaagtattcaaaatgagttaggggttcatgaactccatggttcaaaattaatctaaaacaaaaagacatgcaatcactgttacgtgatccatgtctttttgttttagtaaaagtttgctaaacatattgtagcaatattaaagtaaatcaaaattgaagttatatcacttaaagttgagatgaacggaccactggctacaaccggatccattcctaacttttccataataatcggtattaaagttccgacaaggttagcaacaaagattgccccactcatcgccgccccaacgataattcctaaaaccatgtttttttgccagaataaaatcaccgcaaaaatagcaattcctgttaatagaccaattaaaataccggtaataacttcattcaaaattagtttaaaaacactatcgccttcttcatcattagctagtcggcggattgctacagctaaactttgtgtaccggcgtttcctgcagtacctgtaattaaagtgataaatactgccaacacgccaaatttatcgagtacattttgaaattggctaataaccattgcactaattaatcctaaaaacagcatagttactaaccaaggaattcggcttttgacagctttccaaggattttctgacatatcttcagaattaaccccagctaaacgtgaataatcctgtgccgactcttcgtcaataacatcgataatatcatcaaccgtgataattcctaacattttattacgttcatcaacaactggaattgcaataaagttataatcacgaatttgggcagcaatttcagtttgatcctcatcatctcttacagataccacgttcgtattcataattcgtttgataaatacatcatccggattaacaattaaatccttaactgaaatcactccaattaattgattagattcgttaaccacataaatgtatgaaatagtttccgcatattgagcttcctgtttaacttgattcatagccgagcccaccgttgtatctacggcaactgaaatgaattcagttgtcatcaacgcaccagcagttttttcttcatacttaagtaattggcggactcgggcagcatctacgggttgcatatatgatagaagtttatgtaacttgtcatttcgaacagctcctaaaatatccgcttcgttatcatcatacattccgtttaacaacgctgcagcataactaggtgccatttcgtccagatattctgcaattaaatctggttcatcatcaagttcatcaaatgtatccgccagctcatccgggtctagatacttgtacacgagaagacgttcttcacgcgttaattcaccaaaaaaacgaccttgatcataattatgtaaatcaaggaaatcttctttaaattttttggaatgatgttttaataattctatttttaatttttcaaaaatagcttgagtattatccatgctcttcgtccttctctttattccaatattcaagcatatcatctggaatagacgttttgatatcgatcattttttccgtaaaaacatttttaaaagttagagagaaacaatgtaaggcttgtcgttgtaagatatcgttagccatcccaccgtataattcatctccgactaatggatgtccaattgaactaaaatgaactcgaatttggtgagtacgaccagaatgtagttttactttcagcaaagtaaaatttttaaaggtatcctccacccaatattcggtcaaagacggctttccttcgcccattggagctaccatccttttaataaatgaatctgggtcacgttgaatcggtatttcaatgatgccatgttggttagtaaatgttccctctacaatcgtcaaatacatcttgttaattttacgttgacgtaaatcttgatccatcactgtatgagcaaatcgatgcttagcgaaaattactaatcctgatgtatcctgatctaaccgagttaccacatggacaactcggctttcataattatttttaacataatagtttttaacccggttaactaatgtatccttttgattagctgcagattgtacggttggtaagaagggtggcttatttacaatcaaataatctgcatcttcatatcgaacatcaattggtacatcagatagccctacatgtggattactaggttcaggtggcaaagtcacttcaactaaatcgcctttttcaaccattgcatttgttctcgtaggtaatccattcacaaaaatcttaccgccattaaacttaatactttttaataatgaccttgaaattcttttcctacccaagaaagtccgtaagtgctgccgactctcaaagttaactatccatctaaacttcatcgatactaccaatgaaggaatttcgaactcgattccaaaatccagtatgacgatactttaagaatttcactttttgttcatcaatgctatagtgaacctctttgacatgtttatccagtaaatcgatacgatctgctgtaaaattgtaggttcgatggaaactaggtactggcctaattgtaatagtttcgttgggcgccataattaaagaagctcccaccgttcgaaaaacgcgattattaattgacgcaatttcagccatttgtaatacttctaatctaggatgtacaatcgctccacctaccgaacgattgtatgccgttgatcctgttggtgtagaaatacacagaccgtccccacggaaacgttcaaatagattatcaccaatcaatacatccgctaccattgtcccagacaatttacgtaatgtggactcgttaactgccttataactaatgtgtgaaccatctgtatgagtcacatcaatatttaataatggatacgaaacttcagctcctccatcactcttcaaagccttaactaaggtttccaattcatattcgcgccagtctgtgtaaaaacctagatgtcccgtatgtacacctacaaatcggacctcttcaagaagattaagatatttttgaacggcagatagtaacgtcccatcccccccaatggtaatcaccaccgtaggtttttcgttatcaattacaatctcattttgggataaaatttttgctaaatctttaccaacttgaatggaatgctcatcacttgaatgataaatagctactctcatatttagacatccttttgttctttttgtgctaataaaatttgttttctgatttcagacatttctttgtctaattcatatgatttaaccgaggccttctgcaaacgtgttcttagttcttttggaaattctccgtcaaatttataatttaaagagtgctcgattgtagcccaaaaattcatttcaagtgtacgtacttgaatttctgctaaaattttcttttgaccattcatcatttgaaccggatattccaccacaatatggtaagaacggtaaccactaggtttttcattttcgacatagtctcgctcttcaattaccgtcatatcagtacgcttccgaattaaatcgacaacttcatagatatcttctacgaattgacacataacacggacaccagctatatcctgcatgtcttgttctatgcgttcttctaggacttggcgacgaaccatcttttcttttatactttcaactggttttactcgtccagtcacaaactcaattggactttcttctccattttttagaaactgagttctcatacccctaagcttaacctttaattcagaaacagcctgggaatatggtaataaaaaggtatcccaatctttaatcatgcgtatccctccgaaccaaattaacaacctcttctattctatcatagaaactaaaacttctttttaaacattgttttcagattttttaaaacaaaataattgattttatatttaaatttggtaaagtaaagacagtttgacttatgtaattctttggaggaattaaaatgcttgaaacttatcttttcatcactccctggggtggtgagtgctttaactgcgaaaaagaaactattcgatattttaaatatgctgaggagaaagttgattttaaaattattacagttttaaatatgaacgttgtccttaaattcattaaacgtaatcaacttaaagacgctaattataacgaactttttaaccgaatgtatctaactagccttgattataaagccgctagttatcaaggaaaagccaagggacgtgctttcttaatggcaatgcaaaatgcaatcattgacaacaatgtcccatattcatttgaattaggtagcactattgctagacaagctggtttagatacagccatgtttgaagaagatcgccaatcaaaaatgacgcaagaagactttaaacgggatcaaaaacttgctcatgaaatgggcgccgaagacatcccagcagcggttatctttaatcttaaagatgaagaatgtggagtcttaatggatcactatgactaccaaactcttgcatcggtgtgtcaattaaaaatgattcaaaagactcagcccaagaagttgtttacccctaaaaccctatagtctcctaaaatcaaagcttacttatcctactttgattttttttgccaatttttctgataatgaattataccattgcactttttgagaaataaaataccattcgccatcattactgataacgatgtttttctctaaaagcatttgccaaaattcaatatcaatttgagtaatatcagtgatagatactttaactttttgttctgctaaaaccaaaaagcgcactcgatttagtagtggaatcccacgattcctaaaatcagtgcacagtcgtggaaaatgaaccgtccaaggacatcccattaaatttttaccatttgtatagcacaattgttgtatttccacatatcgttggtcaatttgatttcctagtaaggaatgttcaatcttgtaagcctcatattcaacggtaggtaatttgggtcttataaattcattttgatgacctttgcaattaaaaattctttcttgataaagaactttgcctaaaactgctcgttgcatattaaaaaatgcatggggagcttcttgtttaagagcgtcccaagctaagatccaccatccttcttttttagaaaaacggccaaatttctgtacggtttgaaaaagacttccttttccaagatgtttagggcccgcaatccaataagagattaaccctaatttcaaatacgctttagtccttttttgaatttcctttaacttaattggactacattgatattcaactaagtatatgtggtcatcgatttcaactctcaaatccgctctttgcttaatttctggtagataaaattccgtctgtacagaaatttgacgttgattgaagaaatcgatgaccttttttttacccattaaatgacgtttagtttcaccttttggctgatagccttgtttcttagtaaaggattgatgggcaaaatagttctttttgtattgcccactacatagttttaacgctcgttggcaacttggacaaaagtacttttcattccgatcagcctttcttgcttccactaaagttccgtttttagttattccaattttcattaggttcaccccaatatagaaatacggcttttgggatctttcccacgaaaaaaacacaacaaattaatgttgtgttttggtaaaatctatttttgattatttaaaataacgcttagccagctctaaagctgctccatccataactacttcaccatgttctctaagaacctcgcttgaaacaatagtcgaatttccatattcatacgcgattgctaagtcattcttaatagtttcaggggaattttcactggtaaagaaagttaattctaaataatatatgtcatgataacggtacagaactgactcaattccactattggtttttatcaattctgcaatacttggtaagctttcaaaatcctctaactctatcactgatttttgcgtacttccaactccattagcatagccatttaggtcagctggatttccgtcactcgtatagcttgaatcatcgttatttttatcatttgaatctgtttcggccaattttctctttaaaaagtccgacacttcatccatctccccattactaggagcattgtcttttgatactgattttatagcttcttccatgccatcagttgggttcttactaatgtatagttctaacccattacggttaggtagcacttggaaagtaacagcatcattactagcaaactgatgatctgtatctacctcttctaataccgaataaaagaagctctcgatttctttatgattatcaagtaaatctaggaacgtcacacctcgctcatttaaatcatccgaactaattgttactcggattgtatcatcgttaattcgttccatttccattaatcagcacctccagttctatcgaaactgaatggaaataacagtatatttgttttctataattatcccacaaaatataagacaataccacctgtccgtttcaggtcacccaaaataaaaagaatcatttcgagttactgtggagccttgtaaacccaaagtgattctttttctattttaaaggttcgcgatactttgtgcttttgccaattccagttgacgtacttttcgtggtaagaaacgacgaatttcatcttcgttataaccaacttgaagtcgtttgtcatccatgataattggacgtcgaagcaatccaggattttcttcaattaaattaataagttgttggagtggtaaatcgtccaaatcaacatttaactcttggaaaactttagagcggcgagaaataatttcttccgtgccattctcagtcatccgaagaactcttttaatttcttcggcacttaagggttcagaaaagatatttctttctgtaaaatcaattctgtgttctttcaaccacgcttttgcttttcgacacgaagtacaacttggtgatgtgtataaaataaccatattaaattccccctttggtgacctgtaacattacttaacctgtaattaaaattgtacaatgttatttagcttttgtccacccctccgttaaccttttttcttacaaaaaataaatataacaaaggcatggtttttagaataagaccgtttatttcacactaaatttacacattaaataattatgttaaataattttaaaaagagaatttaataaaaacttatagaatacaaaaatcataagttatgaaactgttttctaaatttcgatggtaagcccaactttaggcgcaaaaatgttgtttttattttttgaaaattgttttgtttcttttaacatttcgtcaatatcaatctggggagataagtggctgatcattaattgctttgcattagacttattaaataactctgccgtctcttttgtacttagatgccattttatcccagtatgattactcaaaaaattggtatctgttactaataaatcactattagttgcaaatttaactaattcgtcaaaatatcttgtatcagacgtaaatgtgaaaatttttccagtttctcgttctacaattcgcgttgcaaacgctggaactgggtgaatcgtctttttgaaactaactgtaaaaggacctaaatcaatttcttcattctcattataacctacgccttgagaagcgtttggccaagttaaagctccaaaatttagtgggtcttctgtatgcccatatattggcaaaatttcaaccttattcttagaatttagttgccattgatactgtaatacccctaagtcagcggtatgatcgtgatgataatgtgttaaaagtactgcatctaaatcaagtggattcaaatgcctttgtaattccaataaagttcctgaaccggcatctaacaataaattataattgccactttgcactaagtaccctgtcgttcccacattttcgctaggatatccaccataatatcctaaaactgttattttcatatttaattcctcccaattactttatgtatctattttaacgcaaagttataatggttttcgattcgttttaaaacaactataatagaatatggatggaggtgcttatgtaatgaaaaatttaaatgtatctttcggtagtgaacccgttttaagagaaatcaaagaaaaatatgcttctcgtaagatgactttattatcaaactctgctaaagaaactagctttcaattagttgatttttccgaccagaaaaatgttttttactcacctaatcgttatagagttctttttgaaagtccattcttaaatatgggtgatatttttatttatgatttttttgatttagcaggtgattctctctcagcttttgatgaaaaggtgcgtcattggagtggcattaatgctgactctagttttttgcaaagtgtacttttactatctcctctagatggaaaaccacataatcgtactgttctaaccatctggagtacgaataagtccgatcaagtcactttagatacacacgatctgaaaaaaactttggagccttacgtgaaccacaactattttagaactacttataaagtactgttgtaatactatgaaattatagttattatactgtatactgttataacgtatatagaaaggaatggttcaaattttcttaaagaagaacaataaggctttaatttcaaatattttttttgactttattgttgggattttctttgtttattatctaaaggtctcagctgacgtttctacattcttacgtactattttaattgtctttgctgcttatgactttacagacatgttttttagtatcaaattattaatagaacaaaaaagaaattctaaaaaataaactttcataagtaaaaaagcacctattaatgcaacagtgcttcccaattagtcagatatttgatctaacttttagggagtactgaacgttaataggtgcttttctttccagaaagactctattgcattcctaacacagttaaattaaagtacaaaaaaagagttagttaaaactaacccattatcattaaaggcggtaaccggatttgaaccggtgatgaaggttttgcagacctctgccttaccacttggctataccgccattataataaaaaagtgtaattactcgcataaaaattacacgaaaattacacgaaatagctcgataacaatcttactaaatttatgccgccggtgggggtcgaacccacactcccgtgaaggaactggattttgagtccagcgcgtctgccaattccgccacagcggcatctagcgttgctatattataaagtaggtctttaaatcaacctaaagggcggtatgtgggaatcgaacccacgcgtgccggagccacaatccggtgcgttaaccacttcgccaataccgccatcatggcagggatagtaggagttgaacccacactgacggttttggagaccgtagttctaccattaaactatatccctatcattggtaaaaacaaaactaaatgtgaactaaacgttcactatggcgcgggacagaatcgaactgccgacacatggagcttcaatccattgctctaccgactgagctaccgagccaaaaaatatataaatgtaacaacggtcctaacgagactcgaactcgtgatctcctgcgtgacaggcaggcgtcctaaccagctagaccataggaccaaagaaaaaattttggaatggaggatacagggctcgaacctgtgacctcctgcttgtaaggcagatgctctcccaactgagctaatcctccaaaataatgacccgtacgggattcgaacccatgttactgccgtgaaagggcagtgtcttaaccacttgaccaacgggtcatacttttatcatatatacggagagtaagggattcgaacccttgaaacaggctttaacccgtttacatcatttccaatgatgctccttcggccatctcggacaactctccaaataaatgatttaaaggaagctgatcttttttgtccgaacagcgttcggattaattttacaatctaccgagatacaattaatttaatgcaacatcatacatccgtgcgtaactttatgccggaaccacttcctgaaagtgtaaaaaatcaattagttttggccactcaaagtggttcatcttcgaactttattcaagcaacttctattattgaggtgactgatcttaaaactcgtgaaaaaatcgccaaaatttccaatagtgatgcatatgtaaaacaaagcggggccttttttgtttttatagcagatttgtatcgacaagctaatatcctaaaacaagcccaattaccattagatgggattcaaaatatggaatcgcttctagtaggagttgttgatacggccattgcaggtgagaacatggcaattgctgctgagtccctagacttaggaatctgttttattggtggaatccgaaacgaaatggatagcattaaggaactacttggtttacctaaatatacagtgccactttttggaatgactgtggggattccagttcaaaaaaatgaaattaagccacgtctacccaaaaagaatatttcttttaaaaaccgatatgaaccatcggttgcagtaaatctggatagttataatcgacaaactcgtgagtattatgctaatcgttcaactacccctcaaaatacggattggtctcataaaatgcttcatttttttgccgaacccaaaagaccagcagttgctgaatttcttaaaaaacaaggattttcactggaataaaaaatgcattactagttttaaaactagtagtgcatttttattaaacaatcttttttctagtaggtaaggcttgtagaaatgccgtagttaaaattaataacccgccgattgtttcagctaacccaaaatgaactcccaataaaaggattgaaagtaatgtggcagttaaaggctcaaaagagctaagcatcccagtcgtatcgggcttcaaataatttaaactacttaaatagaataggtaagataacatagtaccaccaacaataatgtatacaatcaataagatagaagcaggatcaatggagtcagggcgattagttatgattatcttagcaaatggaatgcttccaatcagcatggcccaaccagtaactaaagctgcgtcaaaattcttaagtaagcgacgaggaatcaaagtatagttagcttgtccgacccccgccattagtccccagaatactgctaaaggtgctaaagctagactaccaaggttacctttagtaactagtagtaaagttcctattagggccacaagaatggaaataacatcaattcgtcgtggcaaagttcgacttccaactgccaaagcaagaatgatgaataaagggcccataaattgaaggattgtcgcagtagctgcatttccaaatttgatagctagaaaataagttaattgggatggaaccataccaagtagggcaaagagtatcaaccataaaatattacttttagtataaaaaatggtaaaaatcttcctaccattttttaaaaaactataaacgattaacagactaccagccgtaagtagtcgaactccgaccaaccaaatggggtcaattgactgatgatgaaaaacaaattgagtagctgttccggagccaccccagagcacgctacctaagattgcaaataacaaaccttttgttttattttgattcataagaacacctatccgtatactcaaattcaataatatctatcatacgtggattttccattaaaacaaagcctttttataaaagaatcaactccaattagaaaatatttaagatatttacttttaaactaataagagaaggatggatgaatttagaatggtgttaatctgtaaaaataataataggatgaaaaacgattcttgaaacgctttaaaagttattaaaacgctttaaaagttattaaaacgccgataatagacattcgaaagcaacctaattattttacttttgcctaggaatgggatagaatgaataatcatacatacggaagttaaaagaaaaactagtcgaggtgatcaacaattctaaagaaaacaaaacaatttttgagaagcaataatctacaatatagtaagaaatatatccggccgatgatgacgccaggaagtgtttatgtttttaaatttggcaaagacgaacttaataatcgagcaattattaattacacccatacatggacgggtcgaattaaaattactgagattgatttacgtctgcatgaacaaaagcatcctcgtatctttcgtcgagaaagtgatttattagcttatttaaagaaacatctaacggaaactgatggagttactaacataacacgccgtaaaaaacatcattccaaaaaaataaaaaagtagattgactattgacaccattaagttttatgcgtagtatagtcaattaaagaaaagaaaccttaatttggtcctgtgaggccaaaaggctcaatttgttcggtagaacctcgcacttaacggggaatcatagaatttactgaagcctcttggatcacatcgatctaagaggctttttctatgaaaggaagtacgtggttatggcaaagaaagaagaatatcacaatcctgaggcaattttggatatccatgataaagtaaagtttcctcagttggtaggcctatctattcaacatatgtttgcaatgtttggttcgaccgttttagttccaatcttagtgggtttaaacccaggaatcgctctttttagttcaggtgtgggaacgctgttatatatcttgataaccagagctaaaataccagcttatatgggttctagttttacatttattgttccaatgctggcgttaatgaaaacaacgggctatcaaggcattgcacaaggaactatctcagttggggtagtgtatctgattgtggctttgttgattagttggatgggttcggattggttggataagatattaccaccgattgtcgttggtccaattattatggtgattggtttatcattagcaggaaccgctgctacagatgcaactatgcgatccgttggcagtcaaagcgtgtatgatatcaaatacttcattatcgcactggcaacactgttaatcaccattgtatttaatatgtacctcaaaggctttattagtttaattcctattttgttaggtttaattgctggttaccttatcgcgcttgtcatgggagtggtcgatttatctactgttcaacaagctaaatggttagttgctccaaattttgaaattccatttgtaagttatcagatgcacttcaacatcggggccgtattaagtatgatgccactggcattcgtaacgatgacagagcatactggccacatcatggttttgaatactttaacccatcgtaatttctttaaggatccaggactacactgcacactttcaggtgatggtgtggcatcgattgtagctggttttattggaggacctcccgtaactagttatggcgagaatattggagtacttgcagttacaaaagttcacagtgtctatgttttgatgggtgcagcggtgagtgcaattatctttagtttcgttggaaaattaagcgcattgattcaaagtattcctaatccagtaattggtggaattagttttctactatttggaacgattgctgctaatggtctacggattttaattgataataaaatcgactttaatcagaaacgtaatctaatgattgctgcatcaattttagtaatcggtattggtaatgctagttttaatattggtaatctaagtttctcaggattagcagtggcaaccgttttaggagtcattcttaacctagtccttcctaaacaagctttaagtgaaaaataatttacttttcgtatatttaagcaaaatggtatcatagtatctaaacacgagatattataggagctgattttgtttgaaatggactgaagtaaacgtcaaaacaacaaacgaggccgtcgaagctgttagcagcattttcgatggcctcgatgctgttggagtgaaaattgaaaatgcactagattttgagaattatcgagctagtaatcctgcagaattaatggaattaaaagatattccacatattactgaaggtgcaatcgtatcagcatactatccagacgatataacaaatattgacgtaattttaagtcaattacgtactaaggtgaatgcattagttgactttggacttgatattggagaagccagcattacgacggttgaagtgcaggatgacaactgggctacagcatggaagaagtattatcatccagtccgtattacccgttatttaacggtaaaaccaagttggagtgattaccaagcaagtttcagcgatgaaaaggtaattagcttagatccaggaatggcttttggcacgggaactcatcccacaactcgtctttgtctccaaggtttagaaatgacgatgcgtggtggcgagacactttatgatgtcggaactggttcaggagttttaagtattgctgctaaacacttaggagcaagtgatgtagaagcttttgatgtcgatgatattgcagtcgcagccgctcaagaaaacttcgatttaaatccaattgctaaggatattaaagttagtgctaatgatttattgaaaggggttaatcgccctgtagatacaattgttgctaatattttatccgatattttagtaccattgattccgcaagctaagcaattgcttaattccaatggatatttcatattatcagggattattgatgataaactagagttagtgatagatacattgatagccaatgattttaaaattgaagaagttctacattacggtgagtggcgtggcgtgattgctactaatcggaaagatgattaaggagaaactatgcaaaggtattttgtaaaacagccccttaagatccaagctgaacttcaactttcgaaagaagattctcatcatctgattcgagtaatgcgtactgatattggtcaagatgtggaagttgtagatctagatggtaaagttttcattgcggaagttttgaagagtggatcaattgcaactttaagaactaaagaagatattactaagtcagttgaactaccagttgatattacgattgcgtgtggaatttctaagggtgacaaaaacgaacaaattattaaacgcggaactgaaatgggagctaagcattttatattttttgagtcgcgttactcggtagctcgttggtcagaacctaaagtggagaagaaattaaaaagactacgtgaaattgccaaaggtgcggctgagcaatcacatcgccagcttattcctacggtggtatttattaaagcgcctgcactatttgaaacaaccattgagcatcgaatggtagcttatgaagaatcggctaaacaagatgaacatgctaattttaaatcgcttctattgcaactaaaggctggagaccagctgctagtcgtcttcggtcctgaaggtggatttgcagaagaggaaattcaagaatttactgagcatcaatttattttagcaggtttagggccaagaattttaagagcggaaacagctccgatgtatttattatcagctgtatcttatcaattcgagcttaagtaataaggagaaagacaatgaaaaaaattaataaatggggactttctattcattggcgatacatacttttcgctttcttaattggaattgtccttccaataattttaaaactttgccatacgccatcggtaatgattgttttatggctattaattgtatttaatgttttggcaagttacacgtttggaaatctaataaaatcaaatggattacatttcatttttctatttgtttttcctattttatatttaataggggcctttattattttgcctcattattcatattattttaccatcgtatatttatgtgtagaattactgtcgtataacctttctaacggctgaatattgcaatttattatcaataaacgtatacttaattcaataaaagcgaagcacgtagtcatttgattccgtgcttttattgtattttgaggttggtggtgatattaatgtctaaagaaccagtgttaacggcaaatgaagtaattaaaatgtgccaggagtacatgaacgaagaacatgcagcatttgttcaaaaagcctgtgattttgcgtcatatgtccataaggaacaatatcgtcaatcgggcgaaccatatattatgcatccgattcaagttgcagggattttagccaatctaaaaatggatcccgaaacggttgcagctggatttttacatgacactgtcgaagatacactgattaccttaggtgatatcgaagaactttttggtaaagatgtggcagtaattgtcgatggtgtttctaaaatcagtaaaatcaaatataaatcaaatcaagaacagttagctgaaaatcatcggaaactgcttttagctatgtcacaagatatccgagttattattgttaagcttgcagatcgcttgcataacatgcgaactctacaacacttgcgccctgataaacaacgacgaatatcaaatgaaacgttggaaatttacgcaccactagccgaacgcttaggaattagcacaattaaatgggaacttgaagatatttcactgcggtatctaaatcctcaacaatattatcgaattgttcatttaatgaattcaaggcgaaatcaacgtgaagaatacattgattccgcgatttcagaactaaaatcagcggtcgaagatttacaattaaagcatactgaaatttatggaagaccaaaacacatctattccatctaccgtaagatggtcgatcaacacaagcaatttagtcaaatttatgacttactagcaattcgagtgattacggtgtcagttcgtgattgttacgctgtgttgggcgctatccatgctaaatggaaaccaatcccaggtcgttttaaagactatattgcaatgcctaaggctaatatgtaccaatctttgcatacgacggtggtagggccagaagggcgaccattggagatccaaattcgtactcaagcgatgcatcgtgttgccgagtatggggttgctgcccattgggcttataaagaaggcattaaagatgagttggctcaaaatacaacagatgcgaagttaaactggtttaaagaaattgtcgaacttcaggatgaaagtaatgatgcagccgattttatggaaggtgttaaaggggatctgtttggggatcgcgtttatgcatttacgcctaagggggatgtgtatgagttaccaaagggagctggtccactagacctggcttatatcatccatactgaagttggtaatcatgctaccggagctaaagttaatggcaaaatcgttcctttagattacaccattaaaaatggtgatattgttgaaattttaacttccaaaaattctgctgggccgagtcgtgactggattaatctagtttctactcgacgtggacggaataagattaaacaatttttccgccaagttgatcacgaagaaaatgttgaaaaaggacgggacatccttgctaagcaattggaacaaacagggtacgatgtttctgatttgatggacgatgaacatttaaaagatgttgctaaccaaatgaacttctcccaaattaatgatttgtttgctgcagttgggttcggtgatttagctccggcgggaattgctaatcggttaaccaaggatttacgtaagcaagcagaagaagatcgccaacgagaggaacaaaaacaattgttagaaagtcatcaaacaatctctaatgaaagtaatgacgatcgtaagaaaaagaaatcttcttctgaaggcattgtaattgagggcgcggataatttattagttcgcttaagccactgttgtagtccagttcctggggatgaaatcgtgggatatattactaagggacgaggagtttctgttcatcgggtcgaatgtcccaacgtccgtcaagctgaagaaaatggtgaacgcattattgaagttagttgggaaaatcctaatgatgaatcaggaaattactctgctgacttggaagtagaaggctacaaccgtaatggcatgttaaatgatgttttgaaatcagttaataactctactagaaatctttcatcagtgaatggaaaattagatcataatcggatggtagtaatcagtatgactatcggagtgcgaaatttattacatttacaacgagttatggaaagcttaaaaaatgttaaggacgtttatgtggttaaacgtccaacccattaggagtaatgtatgagagttgtaattcagagagtatcaaaagcaagcgttacaattgaagagaatgtagttggaaaggtcgggccgggattcatgctattagtggctttcaacgatgaagatacggacgctgatctcgactttgcagtacgcaaaattgttaatatgcgtatttttgaagacgatcaagctaagatgaatctgtctattaacgatgtcaaaggagcgattctttctgtttctcaatttaccttatttgcttccactaaaaagggaaatcggccgagctttactaaatcgggtaacccagagttggctagtaaactgtatgatcagttcaatgctaagttacgtgctacaggaattgaagtacaaactggtcaatttggggcggatatgcaggtggaattggttaacgaaggaccggttacgattgttttagatacacaaaataaagaatgattgaaagagcttaaattagaagtcttagactattgttggcgtagagcaaacatagtttagctcctaagataagctcttttttaaggagaaaattatggatattttttatgattttgacggaacgttatttgacacatacccagcgatggtagctgctttggtacaaacagccgttgattaccaggttaagattgaccgaaatcaagcctatcagcaaatgcgtcaaggatccttggaggatgcgattaaagttttagctcgtatagctaagattgaaagtactacgattgaacgtcattttcgagcaattgaaaacgaggaattaaaaaatagtcgaccatttgaaggcgtaaaggcaacgctagagtcggtagtaaaccatggtggtaaaaattatttgctaactcatcgaaatcaggcggcaattactttactagaaaaatttgaaatgaaaacttggtttgaagactttgttactggagacatgactttcccaagaaaacccaatccagcttcattaaattatttaattgagcgaaatcaagcaaacaaaaaaacagcatatatgattggcgatcgaaacttagatatcgacgctgcacataatgctgatataaagggaattttatttgatcctgaccaaattattaatgtaactagccatccagaattaataaccaataattttaaagatattcagacttatctagataaaaaattgattaatccttgatgaacagctttggcgaccttttttggataagaagcactagacaattttttgaaatcagagtcggtgttgatgtatccaccctcaattaaaattgccggacgcttgttatcacgtaagacctgataattagcgaatttgacgcctcggttgtaaagaggaacatcattaatcaattgtttattaatggctttacctaattcaatcgaaccgttatcatggtaatagtaggtagtgtctccagttccggcattattttcaccagaagaatcaaaatggatactgataaaggcatccgcatgatttcggttagcaatttggggacgttcagctaattcgataaaactatcattatcacgggtaataattactttagctccactgtgatctaatttactttgaatggccttagatacacgtagggtatatttcttttcttcatgggattgatcgattcctaaagcacctgaatcaaccccaccatgtccggcatcaatgacaataattgattctgctaaaggagtttctttttgacctttaggaaaagaacggttggtaatccaatcgggaatccagcccattttagtgtcatcataacgaatatgataccagtggttagatttggaaagtacgcttaccgtttgatattgattgagggtcccaattttttttgacgttcggctattagaacttcggattgcaacttgatccaaacctacgtatacggttttagaattaaaaagtggtagaatcaaaaaaattgctacagccccaaacgcaattgatagaccaatttgaacaaggtttcttttaataaagttaaaaataatttctttattcatgctaatctctcttaatttattattattagtatccattatagcaaatttttaagggtacttacttgaagaattcgccttgactaatatggttttttctagtacttttataactaaagttaatataaatcgatgaaaaggactattaaatattgacgacatggctaagagagctcggttgctgaaaaagagtgcatgcgtcgtattgaagacaccttggagatttggtcggcacccattatatatgccgtagagtacaaatctaaggtggtaccgcgtcaagacgcccttgttaaatcaagggctttttttattttctttgaaaaatatttgaggtgaatataaatgaagtatcaaaaaccaaagggaacagcagacatattaccgccattttcaaaagaatggcaatttgttgaacagaatgctcgcgaaacatttgcactttataactacgaagaaatccgtacaccaatttttgaaaagtttgaagtcttttcaagaagtgctggggatacatctgatattgttaccaaagaaatgtatgattttgatgataaaggtggacgccacattgcgttacgtccagaaggaacagccggagtggttcgggcgtttgttgagaataagttatatggaccagaacaccagaaaccggtaaaagtttactacatgggaccaatgttccgttatgaacgtccacaatctggccgactacgtgaattccaccaaatcggggtagaagcattcggtagtgatagtcctaaaatggacgttgaaacaatcatgatggggatggattttcttaaaaaattgaaggtttcgggactaaaattagttatcaatacgctaggtgataaagagagtcgtgatcgttaccgccaagcattgattgattacttggaacctcattttgaagaattgagtgatgattctaaagctcgtctccataaaaatcctttacgtgttctagatagcaaagataaaaacgatcaaaagattgttgaaaatgctccagagattttagacttcttaactgaagatgctcaaaagcactttacaagtgttaaagaagaacttgatacattaggagtagactacgttttggattcatccatggttcgtgggttggactattataaccatactatttttgaaattatgattgcagattctcctttaggaaagggggatgttactatctgtgctggaggtcgttataatggtttggttgaagaattaggaggacctgaagtttctggagttggttttggactaggagttgaacgtctgctcttattactaaatgctgaaacacaaaccactcttcaaagtaaacaacttgatttttacgttgttggaattggcgatcttgttcaaaataatgttcttaaggttgtccatgaactccgtcaaatgaattttgtaactgaacaagattatcttgatcgtaaaccgaaagctcaatttaaatcagcggataagctgaacgctaagtatgtggttaccattggcgaatctgaaatgaatgatcgagtctttaaattaaaggacatgcattctggagaagaacgtaccgtagcattaagcgaaattaatacattaaaagatcttttaaaataagcgaggaatactaatgaaaagaacaacatacgctggtttagtaaatgaacagtatactggccaaacagtaactttaaaaggatgggttcaaaaacgtcgtgatttgggacaactaatttttattgaccttcgcgatcgtgaagggatcgttcaattagtatttagttcagaattttcggctgatgcattgaaaattgctgatcaattaagaaatgaatatgtccttgaagtaactgggattgtcaaacaacgtaaggaaaaagacgttaatcctaaaatgaagacgggacaaattgaagtggaagttcaacaagctaagattttgaactcagctaagacacctccatttgatattgaggatggagtaagtgcctctgatgaattgaagatgaaatatcgttatttggatcttcgtcgtccagaaatgcttaaaggtcttaaaatccgtaatcgaattacgcaagctgttcatagttatcttgatgaacaaggtttcttagatattgaaacacctgacttaacaaagtcgacacccgaaggagctcgtgattatttagtaccttctcgggtttacccaggacatttctatgccttacctcaatcaccacagttgtttaaacaacttttaatgggagctggaattgatcgctactaccaattagcacgttgtttccgagatgaagatttacgtggagatcgtcaacctgaatttacgcaaatcgatttagaaactagttttttaactgctgaagaaattcaagatattacggaaggcttaattgctcgcgtaatgaaggatactttggatattgatgttaaattaccatttgatcgaatttcttggaaagaatcgatggaccgcttcggtacagatcaacctgatgttcgttttgggatggaattaaaagatattagttcaattgtggctgactcagaatttaaagttttcagtggggcagttgctaacggcggagtagttaaggcgattgctgttcctgatggagctaacaacttatctagaaaagacattgataaactgggcaaatacgtagaacgctttggtgctaagggattagcttggttgaagattacagatgacggtttcagtggtccagttgctaagttctttaatgcagaaactgaaaaacaaattatggaacaaacaggggctcgagtaggagacttactattgtttgctgcggatcgtgccaaggttgttggtgatacattgggttatctccgtgttgaacttgctaaacgttttgatatgatcgatgaggatcaatttgctttcctttgggtagtagattggccgttatttgattatgatgaaggtgaccaacgctgggttgctgctcatcatccatttacaatgccaaatgaagaagatattcattatctagatgaaggcgaagaccctcatcaagcccatgctcaaagttatgacatcattttaaatggacttgaattaggcggtggttcaattcgtattaacacacgtgaacttcaagaaaagatgctgaaagcacttggcttcagtctagaaagtgccaatgaacaattcggttacttactaacagcgctcgattatggtttcccaccacatggcggtttagcaattggtttagatcgttttgctagattattagctaaacgtgataatattcgtgatgttattgcattccctaagaattctaaggcatcagaaccaatgacagaagctccaacaatggtttcagaagaacaattagctgaattatcattagatgttgatgttcgtaaaccagaagactaataagaaactagaaaaaagaggatggttaaatcctctttttttattggattatatataaaaaattattaaatgagtatcagtcttcatttcaagtgactgaaaatgttatattaaactagagttaaataaactaagaaagtgattgatatatataatggatcatcaaatcaaaaaaattgcaaaacgtcaccaatacgtggctagaatttcaacatcgtttatctatgcgatcttggtttcgatcgcgatgaactttttttggacgccgggccatatttatgcttcaggtatcaccggtgcagctcaggtagtatcaacggttttaaaaagatttttgtcaatggacgtttcagttgccattttacttttcgctctaaatgtaccgttgttcatcttagcttggattgcgattagtccacgttttaccgtttttacggttatttccgttggtttagccagtgtgatgattaagtttttacatccaatgactttgacaacagaccctataatttgtgcaatttttggtggtgcagtcaatggttatgggacaggtttagcactcaaaagtggtatatcgaccggtggtttggacattttaggaattacaattttgcgtaaaacaggacatagtattggaagtattaacattgcctttaacattttgatcgttgtagctgctggctttctatatggctggccatacgctttttattcaacaattggattaattgttaacgctaaagtaatggatatgacatatacacgacagcaacggatgcaagtgatgattattacggaccgtcctaagagtgtgatcgatagtatccaaaataatatgcggcgcggtattacaatcgtccacggggcggaaggagcttataatcataaggataaaaccgtccttttcaccattgtatcgcgttatgaaatgccggaattggaagcggcgatggaggtctctgatccccatgcctttgtaagtatcaccgatacgattaaaatattaggacatttttacgagcctactttgtgaggagtttattttgaaaaaaatatatttattactagttagattagctcgtttggcgtttggcgccaagaaggcacagtaccaagtagcctattttatgagctttgctggtaacgaaacttttattagagagttagtaaaacagtttggttcagacgaagttttaatcgtctataaaacaaacgtcaaagaaaatgttttacagttgcaacaggagcacatcataaaacatgccatcgagtttaaaaagtttcaagttacgagctttgttaaaggcatcaagttggcccgagtgacactttttgacaattattatccagaattaagtgctatcaataaaaccaaaaaagattatttcattcaaatgtggcatgctaacggagctattaaagcttttggttgggaagatccaagtacatatcatcgttcggtggaagatcaacaacgttttcagcgagtttatgatagttttgaccaaattgtagttggttctgaaaaaatggctgatgtttttcagcgaagttggcatgtagcttccgacaaaattgatcgaattggatatccacgaaccgataaatattttgaagaaagttggatagaaaaagcacgaaaaaaaattcaaacaaaacttccagaattaacccaaaaaagagtgattttgtacgcaccaacttatcgcaaagatgtttcatttagccttccagatgactggcgcaaaattaaggtacctcaggatgcagtattgatagtacgtttacatccccacctagctaatgtggaacgtcaaattgttgatgcatctcctgatcgagtgataatggtggaccattttatttcaactcaggagttactctgtgttgctgatactctgattactgattattcgtctatagcttttgattttagcctattagataatgcgcgttctgtaattttcttcacttatgacttagaagagtttgaacgaacggtaggaattcaggctggctttaaggcagcctttctaaaccaaatggtaaatactgtggaacaacttaatgacgcgattttgtttggcaattcagataagaatgtgattcataaattaaatcaacaatggaatacattgaatgatggccgttctagtgcccgattaattaagcaagttaaagagagatgtacagatgagtagtttaaaaaaacaactaaaaattatcattcgatacgtattgattgttatcaacgatattttaactttattacccattaaaaaaggagtagttttatttgaaagttttaatggtaagggattaaccgataaccctaaggcaatttacgatcagcttttggagatggataatcaaactgctaaactactttattggggaattaagggtcaattttttgatgaaattgtacaacaatatccgaatgctcaaatattaaaaagatggtcattaaaatggatttggatttcagcaagagcaaattattgggtttttaattcaagaatgcccacttggtggaagaaaaatcggaatactaaatacgttcaaacatggcatggtacgcctttaaaacatttagcgacagacatggatcaggtgaaattacccggaagcacgcgagaaaagtacttaaaagaatttgttagtgaagctaaacgatgggactacctagtagctgcaaaccaatattcagaggatattttcaaaagagcttttcgattcagaaaccaatttctagaaacgggttacccgcgtaatgatatattagttcaaaaaaatcaaccaactgagattaaggcactaaagcaaaaaatcattggcaatggagaaaaaagagtcgtgacatatgcgccgacatggcgagaagacgattttatcagtgttggacattatcattttagatggcattttagtctaaaaaaaatgatgggcttacttcctgaagatgtgatgttattaattcgaccacattaccttgtaacagatcgaattgatattaagggatttgaagatcgcgtagttattgattcaacaactgatatgaatgaaatttatctgattacagatttaatggtgacggattattcatctgtaatgtttgattttgctattttaaaacgaccaatgttattttttgcgtatgacttggaatattaccgagatgatttgagagggttttattttaattattatactgagctaccaggtcccattgttaccgatgaaacacatttattagctgaaattgatcaacttcttcaaaataattttgcggagcttgatccagagcgctttaacaaatttgccaagcgttttgtaagttgggaaagagggacagccgctcaacaagtcatagaaaaaattaactatcggagggatgaaaaatgattattggttcacacgtcagtatgagtggaaagaaaatgtttttaggctccgttgaaacgagtattgaaaatggggcaaatgctttgatgatttatacaggagctccccaaaatacacgccgcaaagcaattgaagatttacgtattcctgaaggacgcgccttacttacagaacatgattttaaagacgtcgtggttcatgccccatacattgttaatttaggaaatacttttaaacccgaaagtttcaaattcgccgtggaattcttaaaagaagaggttaaacgggctgatgctttaggggctagccagttagtcttacatccaggagcgcatgtaggagcaggtcccgacgctgcgattgcgtcaattactgagggattaaatcaaattattacaccagagcaaaatgtgaagattgcgttagaaaccatggcgggaaaaggaactgaagttgcaactaactttgaacaaattcagcaaattattactggagtagagcacaacgaaaaattatccgtatgttttgatacatgtcatacgaatgatgcgggatatgatgttaaaaaccatttcgatgatgtaatggatgaatttgaccaaattattggtttgcagaaaatcggcgtaattcatttaaatgattctaaaaatgaaatgggcagtcacaaagaccgccatgaaaatcttggatttggaaccattggatttaaggcgctacattatattgctaattttgataaatttcaaaacgttcctaaaattttagagacaccatgggtaaaagatccagatgctaaaaagcattctccatatcaactagagcttgcaatgcttaagagtggcagatttgatgatacattgattgaaaaaatcatcaataattaaaaaatgtcatagggcaatgataacgagatatttatctcggtgccttatgacattttttagttttatacgagactttccataataattgtggcggtctcctcgatggatttattagcagtattaattactaaacaaccaatttttttaaagagttcgtctgcagattgaagttccttattgatactatccatattagagtaggacgattctggatttaaaccgtaagcaatcatgcgctgccgacgaatattatttaaaacttctttagtggtagttagtccaaaaatcttgttagagtctacctgccaaatttcatctggaatttgagtttgaggtaccagaggcaaattagcgaccttgtagcccttgttagcaaggtagagtgaaagaggtgtcttagaggttcgagacacacctaagaggacaatatcagcttttaagaagccagcagggtcttttccatcatcataggtgaccgcaaactccattgccgaaatcttatcgaagtattttgcatttagtgagtgggtgcgtccaggtttattttcaggggcgagattagttttttcagcaaataaattcactgccggagtcaatacgtccaaatattttaaagtgttttgattacaaaaatcggcagcatattgattcaattccggatttacaaaggtggaaaaaaccattgcatcttcacggacggctttattcaaaatactatctagtaaagagattgtatgaataaacggatgacgagcaaaattaaattccacatctagaaattgagcggctgctgcatgagcgacttgatcacccgtatcaccgacagaatctgaaagaatgtaaatattaattgattttttttgtttttccatattgtttaactcctcagtcttttggtatgatattaacatagttgctttaagttagaaaacgttttctgataaataaataactatcgccacagttatttattttatgttgacggtcataacttattcagttataatatttaagaaacatgagtacttagtacgaattgttatttcgaagctcggagggagggaatcacattgtcaaaaacagttgttcgcaaaaacgagtcacttgatgacgctcttcgtcgctttaaacgtacggtgtcaaagtccggtactctacaagaatatcgtaaacgtgaattttacgaaaaacctagcgtaaaacgcaagttgaaatcggaagctgctagaaaacgtaagaacaagaagcgtttctaatccgatcattgctcctgaatttcaggagctttttttgtatacttaaaagggagatttaaacatgaattttactgaacaacttaataatgatttaaaaacagctatgaaagcgcatgataaacttagtttaagcgtgattagaatgattaaatctgaaattttaaatgaacaaggacgagttggccacgaattgaatgatgaagacttttctgcggttatcaatcgtgcttacaagcagcgcaaagagtctatcaatgagtttcaaaagggtggacgtgatgaccttgttcaagaaactgaagcagaattaaaagttgttgaaaagtatatgccagaacaattatctgacgaagaactccaaacgattatcagtgatgtgattgctgaaacgggtgctacttctaaagctgattttggtaaagtaatgtctaagttaatgccaaaagttaagggaaaagcagacggttctaaagtcaatgaaatcgtaaaaaataccttaagttaggggacgtttacgtgaccgaagaagtatttgaaaaaaatctaatattatctgatccaaatttagaagtttcactattgggaaatcaggaacgttttatcccggtgcttgaagaagggatgaatgtaaaagtattaccatttggtgaacgaatcacaatcaaaggttccaaaaaagcagttgaacaaacttacgaagtactgaagactttattaaagattttaaggtcgggcgtccaattaaacagcgctgattttgtaagtgcaatgaaaatggttgaaaagggaactttggattatcttccagatttgtattctacaattttgattaaagatgctaaaggaaaaccagttcgaatcaaaaactttggtcaaaggcagtacgttcaatccgttaacgataatgatgtgacctttggtattggccctgcgggtactggtaaaacatacttagcggtggttatggccattgcagccttgaagaaaggtgaagtagaacgaattatcttaacacgtcctgcggttgaagcgggtgaaagtctgggatttttacctggggatttaaaagagaaggtggatccttacttacggccagtatatgatgccttgtatcaaattattggtgcagagcataccacacgcttgttagatcgaggagtcattgagattgctccattggcttatatgcgtggtcggacgttagataatgcctttgtaattttggatgaagctcaaaataccactaatcaacaaatgaaaatgttcctgacccgtttaggatttggttctaaaatgattgttaatggggatgttactcaaattgatttaccacgtggtacgcgaagtggattaaaagaagcacaattggttttacaaggaatcaataaaattgaattcgttaactttacagctaacgacgttattcgtcatccggtagtggctaagattgtacaagcctacgatgacaaagaagcgaaaggataaatctgatggatattcaaacatttgatcatactaaggaagaaaatcctaaaaatctcgaattaattaccgatattcttgaatttgctggaaattatttgcatttagatgaagaaacggaaatttcagtaacattaatgcataatgatgaaatacatcaaattaataaagagtatcgaaacgttgatcgtccaactgatgtaattagctttgcaatcaacgatgcagatgaggatattattatggatcctgaaatggcggaggaaattccggcaaacatcggagatttgatgatttcagttgataaagttgctgaacaagctgaatttttaggtcattcttatgagcgtgaattaggctttttatgtgttcatggtttccttcatttaaatggatatgaccatatggaaaaagaagaccaagaaaagatgttcccccttcaaaaagaaattatgaatgcctatggcctcaagcgataagcgccaaacgaaaaaaaatcgttcaatcttccaatctgtaggccacgcgggccatggattgtgggaagtgtttaatactgaacgtaatttccgttatcacttgatgattatggttgtcattattattgcgggatttatttttgcattgaatttgttggaatggattatggttttaggatgcattgcagcagttttggttgctgagattttaaattcagccattgaacgattagcagatttagctgctgacggtaaattccacccgttaattaagcaagcaaaagatattgcagctagtggtgtgcttgtcacagcgctatttgcggccataattgggttattaatttttggtaataagttattctaaattaaagaaacggatataaaatatggaagaaaacaatcaagcatttcactcaggatttgttgctattgtagggcgtcctaatgtaggaaaatcaacatttttaaactacgtgattgggcagaaagttgctattatgagtaacgttcctcaaacaactcggaataaaatccaaggaatctatacgactgatcgagaacaaattgtttttattgatacgccgggtatccataaatctcataataaattgggagactttatggtgcaatcagcaatgtcttcattaaatgaagtagacgcaattatgtttatggttaacgctgacgaacctcgaggagctggtgataattacattatcgaacggctaaagaaaattaccgatcgaccagtctatcttgtgatcaataaaatcgatttagtgcacccggacgaattattaccgattgttgattcatataaagatgctatggattggacagaagttttcccgatttcggcgcttcaaggtaataatattaatgaattggtgacaactttaagtcagcacatgcctgaaggacctaagtattatcctgatgatcaggttactgatcatccagaacgctttgttgtttcagaattaattcgtgaaaaagtgcttcaattgacccgtcaggaagttccacattcagttgcggtggtaattgaaacgatgaaatctaatgatgagggattggttaacattcaagcaacgattattgttgaccgttcttcacaaaagggaattgtaattggtaaaggcggaaaaatgcttaaagaaattggtagccgtgcccgtttagatattgaacacttactaggtagccgtgtttatcttgaactatgggttaaagtttctgaaggttggcgtgataaacaaggaattttgcaatcatttggttacaaaaaggatgagtattaaaagtgaacacagtcgccaatgctgattttaatggcattgtaatgtttgaacgaagccatcgcgaaaatgatttgttagttaagtttctaactaaagagcatggtaagcgaatgtttttcattagaaatgccaaaaaagtagattttaagttaagatcagcgattttaccatttagtcatggtcagtatacggggctaattcgtagtaacggtttgtcgtatattaatgctgcactagatgttcagcaatttgaaaatatttttcaagatatcacgttaaatgcttacgcaacctttgttcttaatttagttgatgcggcttttgatgataatgtcaaaatcacatcatggtttgagcggattaatcgcgcattaattttaattgacgctggaaatgatgctgaaattataaccgatttaatccaaattcaattattaaattcgtttgggatatcaatcacttgggatcactgtgtgatttgtgggcgaaccgatttgcctctagactattcagaagcgttcggtggaatgctatgtcaaagtcattgggaacgagatgagcatcgttggcatttaaaacctaagagtgcgcgaataatcggaattttaagtgcggttagtatttttaagttaggacaaatctccatttcaaaagagaccaaacaagaaatttggaatttaacagctgatatttataaaaatcaagttggaattaatttgaaaagtcgaagctttattgatcaaatgaaaaaatgggaaatttaagtgatttgacaattaactaaatttcttctatcatcattgtagttaatagaggacagtgaagaacgaagtaggccttataagttttcaaagcgagatcagaatggtgggagctgattaaaacaagtctacagggcatttggagtccgtgtaaaactaagttgccagcgattgctggaagtagggtggaaccgcgactcttgtcgtccctacgtagtgtatttttagtacactgcgtagggatttttttgtccgctaaattaaaaggaggaacttatgaataagaaactttcagtccaagaaattattttaacattacaaaaatattgggcagaccaaggatgtatgctcatggaagcatatgatacagaaaagggtgccgggacaatgagcccatacacatttttacgagcaattggtccagaaccttggaatgctgcttatgttgaaccatcacgtcgtccagcggacggacgttatggagaaaaccctaaccgtttataccaacatcaccaattccaagtagtaatgaaaccttctcctgaaaacatccaagagctttatttaggtagcttaaaagcccttggaattgatccattggaacatgatatccgcttcgttgaagataactgggaaaatccctcaatgggttgtgccggtgttggttgggaagtttggcttgacggaatggaagttactcaatttacatatttccaacaagttggtggtttagaagtaaatcctgtaactagtgaagttacctatggattggaacgtttgtcatcatacattcaagacgtggaatcggttttcgatctagaatggggtaacggagtttcatatggtgatattttcagagaacctgaatttgaacattcaaaatattcatttgaagaatctaaccaaacaatgctggaaaaaatgtttaacgattttgaagctgaagctaatcgtttaattgaagaaggtctagtacatccagcctatgattacattctaaaatgtagccataccttcaatttattagatgctcgaggaacagtttcagttacagaacgtgctggtttcttatcccgtattcgtaatatggctcgtaaggtagcacgggcatttgtggaagaacgtgaaaaattaggattcccattattaaaaaataacgaagaggaggtaaaataatggcacataattatttactagaaattggattggaagaaattccggcccatgttgtaactccaagtatcaaacagttagtacaaaaagtaacagccttcttaaaagaaaatcgcttaacatacgactcaattgatcatttttcaactcctcgtcgtttggcaattcgaatcaatgggttaggcgaccaacaacctgatattgaagaagatgctaaaggccctgctcgtaaaattgctcaagatgctgatggaaattggactaaggctgcaattggctttacacgtggacaaggtcttacggttgacgatattacttttaaaacaatcaaaggtacggactatgtgtacgtccataagttaatcaaaggaaagatgactaaggaaatccttacggggataaaagaagttgttgaatcaattaatttcccaacaatgatgaagtgggctaactttgattttaaatatgtacgcccaattcgttggctggtttctattctagatgaagaagtccttccttttagtaccttagacgtaactgcgggacgccgaacagaaggacatcgtttcttaggtgaagctgttgaactggctaatgctgaagaatatgaagcaaaattacacgatcaatttgtgattgttgatgccgacgagcgtaaacaattaatttcaaaccaaattaaagcaattgctgaaagcaatcgttggaacgttacccctaacccaggtcttttagaagaggttaacaatttggttgagtggccaaccgcttttaatgggggatttgatgaaaagtatttagctattccagaagaggtattgataacatcaatgcgtgaccaccaacgcttcttctttgtccgcgaccaagctggaaagctattgccaaacttcatctccgtacgaaatgggaatgaagaatttattgaaaatgttgttcgtggaaatgaaaaagttttaactgcgcgtttagaagacgctgctttcttctacgaagaagatcaaaaacatgatattaattattatgttgaccgacttaaaaaggttagtttccatgataagattggttcaatgtacgaaaaaatgcaacgagttaattctattgctaaagttattggaaacaccttaaatcttaatcaaacggaacttgatgatatcgatcgcgctacaatgatttataaatttgatttggtaactggtatggttggtgaattctcagaattacaaggggtaatgggtgaaaaatatgctcaacttaatggtgaaaaccaagcagtagcccaagccattcgcgaacattacatgccaaatagtgcagaaggtgatttgcctgaaagtgtaacgggcgcggtagtcgcattagctgataagtttgataacatctttagtttcttctcagctggtatgattccaagtggttcaaacgatccatacgcattacgccgacatgcatatggaattgttagaatcttaaatagccgtgattggcaattagatttaaatcaattcaagtcacaagttaagactgaattagcggagaaacatacagcatttggtgtggatgtcgatcaaaactttgaccaagtactcaacttcttcaatgaccgtattaaacaattgcttgatcatcaaaatattagccacgatatcgttgaaacagtacttactggtaataatcatgatgttacggaaattatcgaagctgctcaagtaatagcagatgctaaagcaagtactacatttaaagatgatattgaagctttaacacgagttcaaagaattgctacaaagaatgaagtgagtggtgaacttaatgtagatccacaattatttaataatgcttctgaaggcgaactttttgatcaaattattaaaattgaagctgcaaataatttgacaatgagccaactatttgctaaattatgcaagttgactcctgcgattagcaagtactttgacgcaacgatggtcatggacaaagacgaaaatattaagcgtaatcgtttgaatatgatgagtcggttagctaatttaattttaaaaattggggatctaactaacgtacttgtaaaataaaactctttttacaaggatgatttgaatctgcttaaagttaataaataaataaaacaagccatttagtctaacgagattaaatggcttgtttctttctatgcacaaattaagtaataaaaatgatatagcagcaaattaaaatgtacagacttgacagaagtgttaaaaacaagggcgttttaattgattctattgcttgactgctgtatcatactaacgtatgagtttatcttgcgaaagctggtgagagtatggctggaatgattccagaagatgtaattgatgatgttagaacatctgttgacatcgctgatgttgttggtagatatgtccagttaagaaaggcgggtaaaaacctatttggtgtttgtccatttcatgatgagaaaacaccgtctttttcggtttcggagagtaaacaaatttttcattgctttagttgcggacgcggtggaaatgtttttaaatttttgatggatttagagaatcttagtttccctgagtcagttcgtagagtagcggaatttggcaatattccattagatcagagttatttcaagtcaactagaaagtcgtcgtatacgattgaacaaagtgcattgattgatttatatgagaaagcttctgagttatttagccatattctattgaacaccaaattaggtgaagatgcattacagtatttgaaaaaacgaggaatgaccgaggatgatatcaagaattttgatattggatttgccgccccggaagacaatctcctgctaagtttttttaaagaacataagattgaccaacatttaatggctgaatcaggattgtttattgaatccgaaaatcaaacattaagagatcgattttttaaccgtattatttttccgattaaagatacaaatggaaaaatcgttgcattttcgggccgtagtttggttaaggataagaaccatcctaaatatttaaatagccctgaaacgagcatttttaataaaggaaaggtgctttacaatttttctcaagctcgttcagaaattatccaacagaaaacagtcatattatatgaaggttttatggatgtcattgctgctcatcgagcggctgtaaagaatggaattgcgacgatgggaaccagtttgactgaggatcatattaatgctatcaagcgggtggctgatcgcgtaataatctgttttgatggggatgcgcctggacaaaaggcaattgccagagcaattgagttattgaggcaatctagtgatttacaaattagcgtggtttttattcctgataatttagatccggatgagtatgtgaatcaaagaggaacagctgcatttcaaaatttgatgcagcaaactggggaatcaagtacttcatttcttttgaaatatgatcgaaccggtctaaatctagctaatgaaaatgatcagttagaatacttaaaacgagctttaaaacgaattagtagtctgaaagatgccctagaacaagatttgtatttaaatcaattatcagatgaatttaagattgataagcgtgatttaaaagaccagttaagagaaagtgtagcagatcgaatcgcgcatgcacccaaacagtttgaattggaagcgtcgacgcctccgccttcaccagaggcaatgggagatcaacccgtattcaatcaaaatattcaaaaaaagttatctaagatagatatttcggaatatcgtttgctagctcgtgcattaaataatcatgatgtttggctaaaattacagagcctacccaatttttattttccaaatgaaaagcttgaaacaatttatgtcttggctagtggatatttagaaaaaaatcatgaatataatgttgcagattttatggattatcttaaagaagatgagctacaagcagtcgttgctgatattgaatcaattaacctaagccctgaatttactgaagaagaaattcaagattatcttagcgtgattgaaaattttgctcctttaagtgaacaaatttcaaatgttaaatcggatttagatgaagctactagattaggtaacaaagaattacaacaacaactaactttaaaacttatcgcgctatatcaaaaacaacaacagcttcaaaaataatagggggatcagcataaatggcaaacaaaaaaactgaaacaaaaaagaaaaagagtgaaagtatcatttcttcacctgagtttaaaaaagctgtcaatcaaatcattaaagctcgtaagagtgaaaagaaagttaaatatacacaattaactaaagatttgattactaagtttaaattaactgacgaagatgttgatgatcttattcaacgcattgaagatgctggaattagtgttgtcgatgaaaatggtgatccaagtgaaaaagctttgaaagctcaagaaatttctaaggaagaattagatgatacaaaggctcctgctggagtaaaaattaatgacccagttcgtatgtaccttaaggaaattggtcgtgtatcacttcttactgctgatcaagaagtcgaattagctttaagaattgaaaagggtgatccccgtgcccgtcaagaattagcagaagctaaccttcgtttggtagtatcaattgctaaacgttatgtgggtcgtggaatgcaattccttgatttaattcaagaaggtaacatgggcttgatgaaagctgttgaaaaatttgactaccaaaaaggatttaaattttctacgtatgctacatggtggattcgacaagccattacacgtgcgattgccgatcaagcgcgtacaattcgaattcctgttcacatggtggaaactatcaataaattaattcgaattcaacgtcaattgctccaagatttaggtcgtgaaccaatgcctgaagaaattggtgctgaaatggatatgccatctgataaagttcgtgaaattctaaaaattgctcaagaaccagtttcattagaaacaccaattggtgaagaagatgactcacatcttggtgatttcattgaagatcaagaagcaactagtcctgctgaccatgctgcatacgaattgctaaaggaacaacttgaaggtgttctcgatacgctaactgatcgtgaagaaaacgtactacgtttgcgctttggattagatgatggacgtactagaactcttgaagaagttggtaaagtatttggagttacaagagaacgtattcgtcaaattgaagcgaaagctttacgtaaactccgccatccatcaagatcaaaacaactaaaagattttctagattagttaacccaagaggttccgtgcaggtcgtagatttgtgcaggacctttttttgaaagatataactataattacgaaagatagtaggggtttattttatgaattcgaataatttgtcaccaagactaaaaatagttgctagtttagtaccacaaggttcaagaattgcggatattggatcggatcatgcgtatctagcgattaatttaattaaaaataagattgctaaccatgcaatagccggagaagtcgctcctggaccgctctctaattcgaaagaagaaatcgaaaagagtggggtagttgatcaaattgaagcacgtttaggtgatggattagctgttattcaagataccgacaccgtcgatgtgatttgtattgctggaatgggtggccaattaattcgaaaaattttaaatgacggaaaaacaaaattaaatggggttaagaaattaattcttcaacccaatgtcggagagttggaattaagagaatggttaattagtaataatttcaaaattacccatgaagatatcgtggcggaggaccatcacttgtacgaaattatcatggcggaacctggacagatgactttatccgagaaagagcaaatgtttggaccaattttaatgaaaagtcataatgaggtgtatacacgtaagtggcagcgcgaattaaaccggttgagaaaaattgaagcaaatctaaatgctcatcctagccatggacaagctaaactagaccaagttactaagcaaattagcgatattgaggagatgttttcacatgttatctaaaaaattaattgaccgttttgaaagcttcgcgcctaaaaccattgcttttactaatgatcctgtgggtttacaaatcggaaatgttaataacgatattaaacgagtaatggtgactttagatgttcgacctgaagtggttgacgaagcaattaaacaaaattgtgatatgattttttcgcaccaccccttgatttttcgacctattaaaaatttagatttaagcaacccgcaaaatcaaatgtacgctaaattaatccaaaattcgattttggtttattcagctcatacaaatttggacgttgctaaaggtggcatgaatgattggttgacggaagcaatggggttaaatcatgtccaaacggtgtattctaaccattacgataccaatattggtcgcatcggagtcttaccaactcctgtaactgttgaaaaatttgctaaaaccttgaaaaaaacttttaacttagatgggttgcgcttagtaacaagtgacaatgaagctatggtaaaaaacgttgcagttgtaggtggtgatggtggtaaattttatcctgaaatgctcaaagcgggagcagacgtgtttgtaaccggtgatgtttattatcatacaggacatgatatgttagcggatggcattaatgtagtcgatgtaggtcataacgtcgaaaaaatatgtattcctaagttagcttctttattcaacgaatggaaggctaataatgattgggaagtcgaaattatagaatcgacgattaataccaatccttatcaatttatctaaaaattgggaggcgatttaaatgaatccagagaaaatgactacggcacttcaagaagcaattagcgaagcacagcagattgctgtaaatcgtcaacatcaagaaattggtgtgccagaattatttaaatttttaacacaaccagaccaactggtcgggacactattaacagacttaaaggttgataataatcttgtccaaaccgagttagaccaggaacttgaacaaattagcgtggttagtggtagccaggttagttacggtcaatcgatttcagcagaactaaatcaattattagttcaagcagaacaacagcgtaaaaaattacaagatgagtatgttgcaattgatactattttaattgctttatttaatttagatcagaatcagtttaaaaaattcctgaatcaacaaggtctaactcaaaaacaggttttagccaaagtagatgaatttcgtgggggtgaaagagtgacatcaaaggaacaagaaagtggatataaagcactagaaaaatatgggacagatttagttaaaagggcccacggtgaaaacccagatccagttattggacgtgatgaagaaattttagaagttattcgaattttatcgcgaaaaacaaaaaataatccagtactaattggtgaacctggtgtaggaaaaacagccattgtagaaggtctagcgcaaagaattgctaagggtgatgttcctagcaatttagttgataaaaccattgtttctctagatatgggttcattaattgctggggctaaatatcgaggcgactttgaagaacggcttaaagcagttttgaaggaagtatcaaagtcagatggtcaaattatcttattcattgatgaaattcacacgattgtgggagcgggtaagactgaaggtagtatggatgctggaaatcttttgaaacctatgctagctcgtggtgaactccatttgattggtgcaacaacattagatgaataccgcgaaaacgttgaaaaagacaaggcacttgaacgccgtttccaacgggtgctggttaaggagcctagcattgaggatactatcagtattttaagaggtttaaaggaacgctttgaaattcatcatggagttcgtattcatgataatgctcttgtggcagccgctaaactttctagtcgttatattacggatcgttatttaccagataaggcgattgatttaatcgatgaagcatctgcaaaaattaaagtggaaatgaattccaatcctactgaactcgatcaggtcaaacgacaattgatgcgtttgcaggttgaagaacgagcacttaaaaatgaaagcgatgcagagtcagttaaacgtttaaaggacttacagaaagaattatctgaaaccaaggaagaaaaagttaagctggaatcacgttggtcagcccaaaaagaggaaattaaaaagatcagtgataagaagaatgaattagataaggccaagcatgatttacaagaggctgaaagttcttatgatcttgatcaagcggctattttacaacatggaaccattccagctttggaaaaagaattggaacaattagaaaatcaatccgaaagtgatcatggggattggttggtagaagagtccgttacagataaagaaattgcccaaactattagtcaaatgacaggcattccagttgcacggttggtggaaggtgaacgagaaaaactgctacatttagctgataaattacacaatcgagtaattggccaagatgaagccgttcaatccgtttcagatgcggttttacgttctcgtgcgggactccaggatcctaatcgtccgattggttcatttctcttccttggtccgacaggggttggtaagacagaattatctaaagctttagcagaagcgttatttgattcggaagataacatggtccgaattgatatgtctgaatacatggaaaaagaatcggtttcccgtttggttggagctgctccaggatatattggttatgaagagggaggccaattaaccgaagcggtccggcgaaacccatattccattgttctatttgatgaaattgaaaaagcacatccagaagtgttcaatattcttttacaagttctagatgacggtcgtttaacagatgggcaagggcgtacggttaactttagaaatacaattttaattatgacttctaacttaggttcagatttgctattgaagaatcaatcagaaaataaaattgatgacaacatccgtgaccaagttcaagatgttttgcatggatactttagaccagaatttttgaatcggattgatgatatcattatgtttaccccattaagtaaacaagatgtacgccaaattgtgattaaattaattcataatttatctatacgtttgagcgatcaagaaataagtttaagcatttcggatgatgcacaagattatattgttgaacaggcatatgatccagcgtttggggctcgaccattgcgccgctacattactaaaaatgttgaaactcctttggcaaaagaaattattagtgggcgtgttcgtcctaattcaacagttaatatcgacgttttgaatgatcaactggttttccagaataaataaaaaaaggatgctatctttggtaaaaataccaaagacttgcatccttattttttaggttttgaaattagtgggatcatgttagaagtaataagagctactacagctgccacaataccaatttctaaacgtgtgtatggtagagcatcgagttgaccaccaatgtagccaataacttcaccaaaaacaaatgcccaaaaaataactacgacttgtttcatttcgtttggcccctttctgaacaacagtaattttagcacaattacgtggggaaataaattaaactctatatttttggagaaggggaatttatttagtataattataaaaaacaggaggggataaggatggcttttgtgccactgcaagtattaagttcttacagtttattatctagcccgattaaaattgatgacttaattgctacggcgaaaaatcgtggatatcaagcgatgaccctcaccgatcataatacaatgtatggaacagttgaattttatcaagcttgtattaaaaacaatttaaagcccatcgtgggtttaacgctttggttagatagcacgacgggaattgacaatcaatttgcgctagttttaatagctaagagtgttaaaggttaccgtaatttaatgcagattagttcggccaagatgacgagtagtgcaccaaaatttgtttttgatgatattaaagatttgctagatgatttaatcatgattgttccagcacaaagatcagaaatgattgaattgttggagcgagggctatccggtgatgcaaccgagcttttagaaaattatcgtcaagttgttggtgataaagatctttatctaggaattaatttaaagcaaactaatattatgcgtcaaaccttgatgcaaattgccgaaaaacacagtcttggttgtttgcccttaccgagcgtggaatatttaaatagtgaagaccattttgcaactcaagttttgaaggatattgcttcgggggaagttatcaagcatcctgaaatcctagcaaaggaccaagggaataattggttaaaaccgcgagatgtatttgaaaaagagtatcgggatgccggattgagtggtttattagaccaactagatacgctaactagccaaatcgagctaaaaattccgtttgtccagcccaaattaccaaaatttcccacgccaactaatcaatcggctattcaatatttaaaggaattatgctttcaacagttagaaaaaagtaaaaatgctcaaaatttgcaatatcagcaaagattggatcgagagcttaatgtcattgaatccatgggttttgcggactacttcttaattgttcacgatgtggtccaatttgctcatcaaaatcacatcttgactggaccgggacgtggttcagctgcaggctcgttagtagcttatttactcaggattactagtgtggatccaattgaatatggactgctatttgaacgcttcttaaatccagaacgtgcccaaatgccagatatcgatttagatattccagatgataaaagagaattgatgctcaaatatgtccatgataaatatggacatcaacatgtggggcaaattatcacatttggtactttagcagctaagcaagccattcgcgatgttgcccgtgtttttggggaaatgccgaataaaattaatcaaataagtgcattaattcctagtgaactaaatatcacattggagcgtgctttagaaaattcaagtaagttacaagagtttataagaacttccgaaaaaaatcgatttatgtttgaaacggcgcggcgcttagaaggattgccacgtcattactctacgcatgcagcgggaattgttttaagtgaaaataatttaaccgaaaccactcctgttcagaatggaaatgaaggaatgctgatgagtcagtattccaagaattatgttgagcgggtagggttgttaaaaatggactttttaggtttaagaaatttgtcattaatggctaatattttagatcaagtccatcaacttaaacccgattttgacatcgagaacattaatttaaatgatacaaagactttagaacttttccaacgaggcgataccagtggcatttttcaatttgaatcggctggtattcggaatgtattgagaaaagtgaaacctaatcaatttggtttagtagttgcggtaaatgcgctttatcgtccaggaccaatggaaaatattgatcgatttgtaaaacgaaaagaacatcgcgaacactattcttttcctaatgacgttttatcggaaatcttaggtgaaactttcggtatcttagtgtaccaagaacaggttatggaagttgcttcagcaatggggggcctgagtttgggacaggccgatttgttgcggagagcgatgagtaagaaaaaacatgatgtaattgaacaaatgcggacgaattttattgatggagcattgcaaaagggatataacgccaagttagcccaacaagtttatagttatatcgaaaattttgctaattatggttttaataagtcacatgccgtagcttatagcaagctagcttttcagctggcttatttaaaaacgtactttccaggtcctttttatacagccttacttaattcagttattggtggtgaggctaaaactaaagaatacattcaagaattgaatcgtttagggattaaagttaaagcaccggatattaatttgagccaactacaatatgcattttatcaacaacaaattatcatgggttttctatcaattaaaggattaaggcgagatttcatccgtaatttgattgaagaacgtcaaagtaatggagaatttaaatcagttgacagtcttttacgtcgaatgcgggataagggtattacagaagaaattattgaaaaactaatcttttcgggaactctagattcctttggatataaccgagcggaattaggtgactttttacctgaattgttgaaaggtattgcttttagcgggcaaaatgtggatctttttgaaaagttaatgcctacgattaaacatcgaccggatatggatttggatgaaaagctggattgggaagaagaattattaggaacttacatttccgcgcatccggttgaacgctatgcaaacttgattgaacaaaatgggtttaaaaaaatcgatgaatttagtgatgaagctcaagtgactacgattgtatatataagaagtattcggaccatcagaactaaaaaaggagagtcaatggcctttgcgaatatcacggaccctactggagaaaacgaagcagttatctttccaaggatataccagcatgctaaaattttgagaaacaaacgagtcctacaattacgaggcaaggttgagaaaagaaacgacggtttacaattaattgttaatgaaattaccgcccctcaaaccaaacaggtccaagcagcaatttggaaattagaagtgcctagccgaaataattcatcagaattccaaaccaaactatttgatattttcagaaaatatcatgggaaagttccagttattttagtttatgaggatactaatgaacataatgagttgtctgaaaaattttatttaaatgacagttctgaagtaaaagagcaattagcagaattgctaggaagtcaacatatttcgttaattaaaaaataaattttgaataaagcacttacattcgattaattaagaaaatggtacagacaactgttttcaaaagtgataaaatcaacaatgaagttttgaaaaaactcaatatttctgtttgaggtgaaaagatgaaacgtattggtatcatgacaagtggtggggatgctccagggatgaacttggctatccgcgccgttgcaagaaaggccctaagctctggtcttgaagcttacggaattaactacgggtttgccggtctagttgctggtgatatccacgaattcaaggcagcagatttagacgatatggtttcacaaggtggaacgatgctttattcagctcgttatcctgaatttgcacaagaagaaagccaattgaaaggtattgaacaacttaagaagttcggtatcgatgcattggttgttatcggaggagacggttcatatcatggtgctcttcgtttgacagaacatggatacaacaccattggtcttccaggaacaatcgataatgatattcctttcactgacttcactattggttttgatacagcgttaaacactgcagtcgacgcgattgataaaattcgcgatactgctaagagtcatcaacgggtctttgctgtccaagttatgggccgcaatgctgctgatattgctctttgggctggtgttgcttcaggagcagatgcggttatcgcacctggttttgattatgacgttgaagcaattgccaacaagttgaaaaagaaccgtgcaaacggtaaggactacggaattattgtcatcgctgaaggtgatgctaattcagatgcagctcctgaattcattgaccagcttaagcaatacggcgattttgatgcacgtgctactgtaattggacatgtccaacgtggtggtgttccaagtgctaaagatcgcgttttagcaagtaagatgggtgcttacgctgttgagctactccttgaaggtaagggtggtttagcagttggaatcttagaaaataaggttcaagctcataacatgcttgacttgtttgatgcaaaacatcaagcagatgattcactttaccaattaagtgaagatttatcattctagagttctattaatatttggataaaatgacttaagaagtcttttataatttaaaatcaagggagagattctgtaatgaagaaaaccaaaatcgtttcaacacttggtcctgcaagtacttctgttgacacaattgttaaattaattgaagccggtgctaatgtattccgctttaacttttcacatggtgaccatgaagaacatctaggtcgttataacatggttaaagaagcagaaaagattactggcaagtcagtaggtattttgcttgatacaaagggtgctgaaatccgtacaactccacaaaaagatggtaaccaagaatatcacacaaatgataaggttcgcatctcaatggatgacactttggaaacaacaaaagaaaagattgctgttacatatgatggactttttgatgacgttcatgttggtggacacgttctttttgatgatggacttcttgattttaagattgacgaaaaagatgaagaaaaccgtgaattagttgctcatgcaactaacaatggtgttcttggatcacgtaagggtacaaatgctcctggtgtttcaattaacttacctggtattactgaaaaagatgctgatgatattcgttttggtcttgaatcaatgaacatcaacttcatcgctgcaagttttgtacgtaagccacaagacgttcttgaaattcgtgaattgttggaagaaaagaacatggaagatgttcaaattttccctaagatcgaatcacaagaaggtatcgacaacacagacgaaatcttgaaagtttcagatggtattatgattgctcgtggtgacatgggtgttgaaattccagctgaaaatgttcctttggtacaaaagacattgatcaagaagtgtaatgcagttggtttgcctgttatcacagcaactcaaatgcttgactcaatgatcgaaaacccacgtccaacacgtgctgaagcttctgacgttgctaatgctgtttgggatggtacagatgctactatgctttctggtgaaagtgctaatggtgactatcctgttgaagctgttgctacaatggctaagattgacgaaaaagctgaaaatgctatggctgaagacggaaatcttcaaatcaacacatttgatcaaagtgatgttacagaaacaattagtgctgctgttgctcgtgctgctaagaaccttggtgttaagactatcgtcgctgcaacacaatcaggttacacagctcgtatgatttctaagtatcgtccagatgctgacattcttgcaatcacatttgacgaacgtgttcgtcgcggtttgatggttaactggggtgtacacccaatcatcgctgaccgtccatcaacaactgatgaaatgtttgaactagctgctaacaaagctgtagatcttggtcttgctaaagaaggagacttgattcttgttgttgctggtgttccagttggcgaaagtggaacaacaaacatcatgaagttacaactaattggttcaaagcttgcttctggccaaggtgttggtgatgaaacagttattggtaaagcagttgttgctacatcagctgatgaagctaacaaaaaagctgttgaaggtggagtgcttgttacaaagacaactgacaaagactacctaccagcaattgaaaaatcaagtgctttagtagttgaaaatggtggtttgacatcacacgctgcagtagttggtatttcaatgggaattcctgttattgttggtgtacaaaacgcaacttcaatcctttcagatgatgaattgattacagttgactcacgtcgtggtattatctaccatggtgcatcaaactcactataaaaatttaatttaaatttttaaaacctggaacattatatgttctaggttttttatttggcagaatgaaagtcgaatttagactgttagggttcttgtattaactaaaaagggatactactaatttcattactttagtagtatccctttttagttaatacaaattataaattcaattatggatcttaactccaacgattttccttagaaggcaagatcattaaaataaagaaccagattgtaccgattagtgggatgatttcaattaaaatccaccagccacttcgatcggtgtcatgtaaacgtcttactttaagtgtccacatacccagccaaacgatgaatgcaatgattttagaagctagattaatattcaaatcacttagattgtagatgtcttcaataggatgaccagtaatagattggataattgcgatgatgattacacctaaaatataattgataataactggccaccagtagtcgggacgattggcagtacctgaaaaattggtgatattatgccagaattttttatatgattcaaccatcaatatgtcacctccaatgcaataaacagcttttaaagacttcagtatttagtcataatgtagtttttattacattttagtatagcaaaggtagtcaaaatgtctaataaagtgaatgtttaataatataattggcaaagataatgctgaatttagaaataatcctacttgggatttattgtttgattaagaagggtatattaagttaatgctatgggaataagaaattagaggcgaggaaacctctagaaatatgttagaatgtagaatgaatgaaaattgagaagcattgtgcttctgcgaaggactgtccgtcgtttttgacggtcagttttttaattactaattggaagataattaattgtagtgttggcccttaaggaaccctgatatattgatgtcggttctatggactaatgtacatatattatgtaaactagaaattggagtggaatttaatggagagttggctatttttgattggaatctttattgtggcgttattaggcaaaaatcaatcattaattatcgctagtattgtagtactatttttaaaattaataccgtactcagataaaatttttcctttattaaataaacaaggaataaactggggggttacgattatttcaattaccattttagttccaatagcaactgggaagattgggtttatggatttagttaattcatttaaatcaccggtgggctggatagcagtagcttgtggtatcttggtctcactattgtcgtatcagggagtaggcttcttatcagctagtccagaagtgacagttgctttagtaatgggaactatcattggggtagtgtttatgaatggcattgcagctggaccaatcattgcgtcaggaattgcgtatttgattattcaacttttacaaattcaaattaaataaaaatgggtgaaataaatatggatacactattaggaaaagtcgaaaaaggtaaagttattgatgaaaatgatgattattattttgttcaattgtcagatggaaatgcctatcgacttgataaaaaagaaattaaaaaaccactgaagaagggtagtttctttactggatttacttatgaaaatgcagatcatgaccgccaaataacacgtgaaacgccacgagcaactgctggcaaatatggttggggaacggttgttaaaacgcgtaaagatttaggagtcttcgttgacattggtttacctaataaagatattgttatttcgttagatgaattaccaacagaaacaaatatctggccgcatactaatgatcgtattttagtttgtctgtctgtagacaaaaaggaaagaatgtgggcacatccagctgactatgatgtttttaaggcaatttctgctcgagcagataaaacaatgattaataaaaatgttaatgcaacggctttccggttaaagatggctggttctttggtattgactgataactttttgttaggatttatccatgcttccgaacgagatcgagaaccacgattgggcgaacaattaaatgcacgggtaatcggggttcatccagatggaacgttaaatttatcattaaaacctaggaattatgaggctctaggtgatgatgcagcaatggttttagccatgctacaacatacccaagaccaaacgctaccattcaatgatcatagcaaaccagatgcgattaaagaacgttttggtattagtaaaggacgtttcaaaatggcattgggacatttgcttaaggctggtgtaatccaacaaactgaagatgggattgttttaaaggagaaatagtcatgaatgatttaatcaatgactatttacattctcttaaagtagagcgaggcttatctgataatacaattattagttaccgccaagaattacgtcacttgaatgactatttgactaaagaaaaaattacagatataaaaaaaattgatcggtatacaatcttagattatttagatgagctcaagaaaactggtagggcaagaagttcttcaattcataccatttcaagtttaagaaagttttttaagtacttattgattgtggataagattgatgttgatcccatggttaatattgatccacctaaaagagctcaccatttgccttcagtactaacgacagcggaagtagaaaagctgttgcaggttccaaatacaaatgaaccacttggaatgcgggatcgaactattctagaagttatgtatgcaacaggattacgagttagcgagttaattacattgaatttaaacgaactccatctggagatggggctaattgaaacgattgggaaagggaataaaaaacgaatcattccaatcggtgacgtggcgattaaatggcttaatcgatatattaatggaccacgtagaattttattgggtgataaaaagtacaatgaaatcttcttaaaccaacatggacatccattaacaaggcaagggatttggaagaatcttaaagctcaggttaaaaaagctggaattgaaaaaaatattactccccatacccttcggcattcttttgcgacccatttgttagagaatggagcagatctcaggattgttcaggagctattaggtcatgctgatatttcaacgactcaaatttacacgcatattacgcagcaaaggttggttgatgtatatgacaaatatcatccacgagcctaaagataaaggagcaacatgttagtaaaatattcggattcaaaaagacaaattgcgatgggattattgtcgactgttcaagcatttaattcaattgatgtagtacggttggtcttagagcggtttactaaaggaaatcgacagatttatttagagcgaaaagatggaacttatattggaatcgtaatgattatcttagaagaagagtgtcttgtagttgatcgcatggcttttattgcaaacgaggaaacagtattcaacgaaaatgaaattttaagatcattaacttctatctatccagaccgtcgtttaatggggtcgttaaaaactagcgcaatgattgaaagattcgaaatggggcaggtaaatgaaagctgaaaattataccctaccaaacgttaagctagctgaatttgagggaccgctagatttattattacatttgatacgaaaatcacagatgagtatttatgatataaaaatatcagaaattactgcccaatatttacaatacttacattcacaagaatcgctagtgttaaatattgctggagagtatctagtgatggctgcaaaattaactgaaatcaaaggaaaattactactaccacatgatgaagaagtgattgaggaagaagatccacgtaatgacttagttgatcaacttttagtttatcaaatgtttaaggaagcttcggaaggcctaaaatcacttgaaaaagaacgacagacctcgtttacacgcccagaaatggaaattcctcctaatgaagctaatcgcttagctccgggcgttaaaataagtgacttacaattcgcacttcagaaggttttagcgcgccaagcgctcctagaacccacttatagaaccgttaaagcagaagaagtcactcttgaagaacgaatgtcagaaatcaaaaaacgtatttttgatttaaagcaatgctgttttgaagatttatttattggacattttagccgagaaacattagtaacaacctttatggcaattttggaactagctaaaaatcatcaaatcttacttgaacagccagcaagaaaacaatcaattttaattaagttaggtgaagtttaatgaataatgagcagaaagtagaagccctactttttgtagcaggggctggaggaatttcagttgaagaactatctaatttcacgggttatgctaagcctgctatactaacgatgctagataatcttgaaaaaaattacgaagttaattctaaaactgctttgaagctaatccaaactggtggtacttacaaactagttactaaacctgagttagcatcgattttagaaaagtattttgatcgaaatagtcgctcaggactatcgcctgcagcattagaaatattgtcaattgtggcttatcgtcaacccataacacggattgaaattgaccaaattcgcggtgttcaaagtggcacgactttacagaacttagtacttagaaatctagtgaaagtggttggtagacttgaagagcctggaagacccaaaacgtatggtacaacagatgagtttttagattattttggtttagaggatattaaaaatttacctaaacttgaaaaagttggagaagattcagaattagacgatagcgatttatttttacaagagtttgaatcaaaaatgaatttaaataataaggagaaataaatggaagaagaaagattacaaaaagtaatggctgaagcaggagttgcttcaagacgaaagtcagaaaaattaattactgaaggccatgtacgtgttaatggtaaggtgattaaacagctaggtacaaaagtaactgcccacgataagattgaagttgatggtgttcctcttcaacgagaaaagatggtttatttcctattaaataaacctcgaggggttattacatccgttagtgatgataaaaagcgtaaaacggtcatggactttttccctgacgtagttgaacgtatttatccagtggggcgtctagactatgatacttcaggtgccgttttaatgaccaatgatggaactttagcaaatggtttaactcaccccaaatttaagtttgaaaaaacatataccgcaaaagttaaaggaattgttaatagtttagatttaaagaagctagaaaatgggttggtaattgatcataaaaaaacagctaaagctaaagcacacttaattagcacggatgatgaaaagaaaacttcgattgtgagcctcactatccacgaagggcgtaatcatcaagttaaaaatatgtttatggcagttggtcacccagtccaaaaattacgccgtgatagttactcatttttaaatattgatggagtgcaatctggaaaatggcgtgctttgaaggttaatgaaattagtcgtctaaaacgtcaaattgaaaaatgattccagaagatgttttagctttttttgatcttaagcaggggcgccgtccgaaggcaattttgaatgtattggttggtaaaatgacggtttcggccttattttggggcttagaatacgatattttggagtacctaaatttctggaaaacaattgatacaatctcttttctagaaaatgttgaccgagctgttgaaggtggttttttagccaaaaaggatgagttgatttatttgacggaggcaggacaacaaaagcaattcagttgtacgactcctacgccttttattaaaaaagttcggctcgatgaggcaattaatttgttgctattagctaaccaggtaatttccgaatttagttttaaaaacaatcgttatatcccagttagtgataatcttcgaattaatgtgatcttaaagaattggtttaagcaacttaagtcaaaaaaccatcatacgacagaccttgttcagaaatatacgcagggtttagatgagcttttaagtcaattacaacagcacgatgcagacatcttgcttagttatcttcccaatcatgttgatccggggtggactattgatcaactagctcaggcatttggaatcagcaaatttcaaatggaacttaaaattaggttgatttttagcaagattattagtgatgctgttttaacaaaaacagcaccgtttgttgatttattaaattcaaccattaaagaaaatgttatgccagatagcacttatcaaacgtggcaattaattcgacaaggtaaaacggtggacgaagttgcacgtttgaaacatgttaaaactaataccgtgaaggaacacatcttgatggcagcaattttggattctaattttccatttgataagtttgttagatttaattttgagattgggaagcatcctacagaagttgactttagaagtatccaaagccaaattgcagatattacattttttgattttaggctaatccaaatcagaaaaattaaggaacaacagaataataatggtaacagataaaaaaatttatcaagtcttacatgagaaatttaattttactgagtttaaaacgggtcagttagaaattttacataaactttttgaccatcaccatacattggcgattttaccaacaggagctggaaaaaccttaatttatcaaatgtatggttttttaaatgagggctccgttattgtggtttcgcctttattatccttgattaaagaccaaatcaaccggttaagattaagtggggaacgtcgtatagcagagataacttctcaaatagattttatggagcaaaagcaaatccttaacaatttagaaagatataaatttatttttatatcacctgagggattgcagcgacctgatgttcaagcagcgatgcgacgaatagagatcgacttatttgtagttgatgaagctcattgtatcgttcaatgggggaagtcgtttcgtccagactacttaaaaattggtcggatacgaacgcaattaaacaaccccctaacattgatgttaacggccacagctggaaaaacaacccgtgaagaaatcgttaggtaccttaatttgaaaaaaggtgaggttgaagaatatattagttctgtcgatcgctccaatatctatcttgattttttagaagtcgaaagtagaagtgacaaagatgaaaaacttttagatttacttgatgagttaccaggggcaggaataatctacttttcaagtcgcaaagttgctagccaagttagcgaaatgattaataataatcttactcttacttcggctccatatcatgcagggatgacaaactatgaccgttttcaagttcaaaaacagtttcaacaagatcaagtcaatgtgatttgtgctaccagtgcgtttggaatgggtattgataaagctaatatcagatatgtaattcactatcatttgcccggagacattgaaagttatgtccaagagatcggtcgtgctggtcgcgatggacaacagagtattgctattatgttgtatgcggctggcgacgaggtaattccttcaattttaaatgatattgaaattccttctgaagcaatccttactgaaaatcttgaacgcagtggtatagatgaagagcagaaagaattaattaaatattatcaagaaaatgggttaactcctcaagaattaacagagctatttaaaagacaacaattgcaaaatgaacagcaaatcttaagaatgttaaaactcattcaaacggagaattgtcaccgtcaatatttgctacaatattttgatgagggcttcaaaaaacaccatgatttatgttgtggttcaatcaatactttcgaaaaattaaagttagaagctaatttaacaactaaaaaaatgcaaattgaaccttggaaatcgagattaaataaaatttttgcaggaatatagcgtaattttcgtggtcattcaaattgaattattgtaaaatacaatttattggtatgtagtaggaggataaacatgaacgagaaaaatgatgggaacttaaaggatgagcaaacaccggagaattcagatcaaaaaccaagtagtgaagaaccaagcgctgatcaacaggcaggcgccgaggattctgccactactggaggacggggagaattccataaaaataaaaagaaatctaagaattttgctggatcattaatttgggtgattgttattttagctatcgcgtcgctagcttattacatgacacaaaaacaagattttcaacagaagacggcgaatacaacaactacacaggtagctaaatctagtagtgataaaaagaaatcaagtaaatcaaaggcttctaaagaagaggatgacaaatcttcgtctatcgctaaagctgaatcagagtccaaggctaaagttaagtctgaatcagaatctaaagcggcagcagctagtgaagatgcaaattcgactagtgaagcctcttctgaggtaaccagtgagagttcaagcgtagaacaaagtgatgccacaagtagctctagtaccgatggcaacgcatcttatgcaactgttcaatctgggcaaggtatgtatcgggttgctgttaacaatggtatctcggttcaaaaattaatggaattaaatggtttaacaagtagttcagatattgaaccaggacaacaacttagagtaaggtaggttattagtgtattcatgaataataaatatcaaattgcaattgatggtccggcatcagctggaaaaagtacagttgcaaaaattgttgcaaaggatttgcaatatgtttattgtgatacgggagcaatgtatcgagtggtaacccttaaggccattcaaaatggtattgaccttaacgatgaaacaaaaattagtgaaatgcttaatgatacggatattcgcttcgaaccaggtgagccagttcaaaaggtctttctggatgggaatgaagttacggaagatattcgccaagccaacgttacgaactctgtatcaaccatcgctgctcaaaaagcagttcgagaagttttaactaactggcagcgtgatcttgctaagaatggtggcattgtaatggatgggcgcgatattggttcagctgttttaccaaatgcagaagttaaaatcttcttaattgccagtgtccaagaacgtgccgaacgtcgttataaagaaaacatagctaagggtatggaaactgatttagagcaacttaaaaaagaaattgaaattagagaccataaagactcaactagaaagatttcaccattgacaaaagccagtgatgcaatcgaggttgatacaacttcaatgtcaattcaagacgttgtaaatgaaatattacgtattgtagaaaatgcatccaagagaaagtagcaacaattactagcaattggagcagtttttcgatattatatatgtataagtgctgtaaaagggggatttattcggatggccgaaaatgatgttaatcaaaacagtgatttactcaacgcaattaatagcgttgaagaagtaaaagttggtgatgtagttaccggtgaagtattggatattgatgacgatcgtcaagtgatcgtaggtattcaaggtgctggtgtagagggtgttgttcctttacgtgagctatcaactcaacatatcgataatattagtgatgaagtaaaaattggtgatgaactagaacttgttgttatctcaagaatcggtgatgacaaggaaggtggaagttaccttctttcacgtaaacgtttgttagctcgtaaagtatggaaagaaattgaagaaaaagctgctaataatgaagaacttgatgtccctgtaacacaagttgttaaaggtggtttggttgtagatgctggtgtacgtggatttattccagcttcaatgatcgaaaatcgttttgttgatgatttgaatgcttacaagggtcaaactcttaaagttaagattattgaagttaagccagaagacaaccgtttaatcctttcacacaaagctgtattaaacgctgaacgtgaagctaaacgcggtgaagtacttgcctcaattaaagaaggcgatgttgtaactggtaaagtagctcgtttaacaaactttggtgcatttgttgaccttggtggaattgatggacttgttcatatttctgaaatttcataccaacgtgttgacaaaccttctgacgtgcttaaagccggtgaagaagtgcaagttaaagttctttctgttgatgcagaaaaagaacgtgtttcactttcaatcaaacaaacacaaccaggaccttgggacaatatcgaagaaaatgctccagaaggtgctgtattagacggtaaagtaaaacgtctaacagatttcggggcattcgttgaagtattccctggcgtagaaggtttagttcatatttcacaaatctctcacaagcacattgcaactcctgctgacgttcttaaagaaggacaagacattaaggttaaagttcttgaagtacatccagcagaacaccgtcttgctttgtcaattaaagctttagaagaagctccaaagaacgaaaagaaaacggaagctcctgcagcagactttagtaaagatatgcctgaagaagcaactggattcactcttggagacattattggtaagagcttagacgattcagaaaaataaattataagtgttaggattaataatttaacatttttcccatgctagattatacctatcgactcagttagagaggccttggcggagaatgatagtctgtccaagacctttttaatttgtaaggaaagggggctaattcaatatgagtaacccaaccgtagcaatagttggccgaccaaatgtcggtaaatcaactatttttaatagaattgctggagaacgtatttcaattgttgaagatactccaggtgtaacacgagatcgtatttatactcatagtgaatggttaggacataaatttaatttgatcgatactggtggtatccagattggtgatgaaccattcctagaagaaattaaggatcaagctgaattagctattgatgaagcagatgttattgtatttcttgtgagtgtacgtgagggagttagtgatgctgatgaagctgttgctaaaattctctataaagctgataaacccgtcattttggccgtcaataaagtagataatcccgaattaagacaagatatttatgacttttacagcttaggtttcggagaaccgtttccactttcaggaagtcacggattagggcttggagatttacttgatgaagtaatttctaaattcccagaagataaaaatgaagaagaggacgacgccattcgctttagtttgattggtcgccctaatgttggtaaatcatcattagttaacgccattttaggtgaacaacgggtgattgtctcggatattgctgggacaacacgtgatgcaattgatacgcgtttcactaataatgaagacgaatatgtgatgatagataccgctgggatgcgtaaaaaaggtaaggtatatgaaaataccgaacgctacagtgtgatgcgtgctatgaaagccatcgacaatagtaatgtcgttttagtcgtgctgaacgctgaagaaggcatcagagagcaagataagcgtattgctggatatgcgcatgaagctggccgcggtatcataatcgtggttaataaatgggatacccttaagaaagataaccatagcttatctaactttgaacaggctatccgttcagaatttgcttacttaagttacgctccaatcatttttgtatcagcagttactaaacaacggctctcacagcttccagaattaattaagcgagtagataccaaccatcgtcgtcgtatccagtcttcttccttgaatgacgtgttaatggatgcaattgccgttaatccaactccaagtgataatggaaaacgtttaagggtttattacggcacgcaggttagcactgaaccacctacctttgttgtttttgtaaatgatcctgatttgatgcatttctcatacgaacgcttcttagagaataaaatccgtgaagcgtttgactttgagggaacacccgttcatttgatagaacgtagacgtaaatagctaagattgtattataagaacgctctaaaatatgaaaaagcttgtcacgtcggtgtttgtatgatatatttcaagttgaaataatatcagagtattgtttcaacatttttgatcctttcagaaatgacaaaacatttcgttttgataaataattttcaggaggtgaaatacatggcaaacaaagcagaattagttgataacgttgctaaagtaacaggtttaactaaaaaggatgcaaccgcagcagtagacgctgtatttagctcaattcaagatgacttgaagaagggtgaaaaagttcaattaatcggttttggtactttcgaagtacgtaatcgtgcagctcgtaagggccgtaacccacaaactggtaaagaaatcgagatcgcagcaagtaaagttcctgcattcaagcctggtaaggctttgaaggacgctgttaaataagcggttttctgaactttagtcagcatagctctgttatgctggctttttgtttgcctataaaaatttatggataataatgagtcatattcacaaaaaacattagcagcacttgagtcggggcagattgaagaatcgaaccgtctatacagctgggctcttcgaaaagatgacaatgaaacgctatataatttagctggagaattatttgcattaggatttgatggaaaagcacttcgtatatacgaaaaattgatcgaagaatatcctaatgatgatgaactgttagtcttggcggctgaaattttaattgatcaaggtaaaaatgatgcagctctagaaaatttagatcaaatttcgcctgactctgagttttatgtatcatcattaatggttcaagcagatttatatcaaaccgaagagctgtatgaggtttccgagagaaagttagttgaagcaattaaactagccccagaggagcctgctatccaattagccttaggtgagctgtattatacaacgcaagactactcaaaggctgtaaactactatctggggttaattaaaagtgggatcagcgaaatgtcccaaattaatattgttgaacggttagcggtctcttatgccgcttatggaaagtttgaaaaagcgattgcctactttgaacaaattcatgaagaagatttgacaccagatattttgatgcaagaaggaattacttatcttcagttagatgaaaatgagagagcacaagcaactcttgaaaaagtaattgaattggatccttcttatagcagtgcttacccatatttaattaattcttatcaaaaagatgagcaatgggacaaaggattgattgctgcccaagagggcttggcggtcgatcaatacagtcctgagttgtaccttcaagcagcagaaatggctgagcatgctttagataatgaattggtggaaaaatacctgcgtaaggcaattgaattagcacctgaaaatacagaaggtatgattcgcattaccgatttttataatcgaattggaaaatatgatgaaactttacgtttcgctagtgacgatataactgatgctcaattaaattggaatttagctttagcatattggaagacagatgattttaaaagggctgctagtcactttgatgcagcattgagtgatttaaaagatacaactgcctttttattggatctttaccattttcttagggagagtggacagttggaacacgctgtcgatatcgcacgtaaatacgtaaaattagcaccaaccgatgtcgatatgcaggatgaattagaacagctggaggaacaaggttattaataatttaaatgataaattcaaagtgaaaagttgggcgcctaagttcaataaaaaaatggttgaagtgatgcgtaaaaatcaatttaaatctgataattcagaggattttaatggcttcaaacaaattgattttaaccaacaacaagatttaatgaagaatgaaatctctaaaaaatatgaaattaaagtggttactagttttaatgagcgtacaatttttagcgtaatcggacgtaacgaacataatgaatttttttatgtaattgataaaaatgttcaaaatgaagtttccgttgaaaagctaagagcattattcgataaataatagaaacagattccgtcaagcgcggaatctgttttttaatatagatttttgttcaattagttcttgattatcttaataaacgaacattaataataaattcagttgctaattaaccagtttttaactaaaaagtgaaaaaatatggtatagttatatacacataattgaaggagtgagtaaaaagcatgggaaactcagtatatttagcagggcctttctttagtgatttacaaattgaaagagtacgtaaggttgaagaacttttaaagaaaaattctacaattgattcaaaaagaatttttgtaccaatggataatcaatatgatactaaggaatttggttcatttgaatggcaagtgggagtctttgaaaccgatgtgcgtcaacttcgcaaagccgatattgttgtagcaatcttagattatactaaaaacggtgaagaaatcatttcagatcctggaacagtatttgagatcggtactgcctttgaacatggtaatcccgtagcacttgttcaatttgatgattctgacaaaattaatttgatgcttgctagaagtcacactgctttctttaatggtgaaagtattaaggacttggcaacttatgattttaatttgttaaagccggtatattctgatttaacagtattctaaagctaattaaaaaacatcagttatgtatttaagtttatacataactgatgttttttaattagggatatttcgatttttagcactgggcgaatcgtaggtaaaaccttcaccaatggcttcatggacatcaataatagaagtaaacgcctgaggatcaattcgtccaatgatacgtttagcaacgtttaattcgttaggttcaattacgcaataaaccatttcacgctctgttttagaataggcaccagacatatgaatatagcttgccccgcgctctaactcgtccattaaggcatcagcaatctcttggtttttgctactgacaattagtaaaccatgagcagcataggctcccacttgtgtaagagaaactagacgagaaaatacataagctgctagtagagtatacatcatatgaaggacatcgatgtagcaaagagaaatggttaatacgacggcatctaaagcgaaaagagtatgccccatggcaattccacgccgtttctcgagaatgcgagctacaacgtcggttccaccggttgtaccaccgaaacggtaaacgatcccgctaccaaaaccaccagcgattccggccaggattccggcgataaacatatcatgatgaatatcgagactgatgggtactcgttgccaaacgtataaccaaaatgagagcgcaaacgtcccaaaaattgtgtaaattaaagatctttttcccagaaaacggtaacctatgaaaattaatgggatattaattaaaattgttgaaagtgcaggatcaattcctaataaagctcgtaaaattaaggtgacccctgtaattccaccttcagctagattattagggatattgactacagccaaccctaaaccatacagacaacaacctaaggcaatcatcacaaaatctaaaaatcggattgattcatctttttgcataatagacctcctacgtagaaactgaagtacttgcaaatatcataccatagagcggagcaggcttttcaaaaaaatcatacgctggtagaattattaagacgatgttagagtatgtgcaaaatttttatacttaattcggtaatcagttaaaagatagtacctttacttaaatcggattgatgcgcatactaagttaaagaatttattatttaaggtgttacgagaaagtaattcctttgaaacggatgtggaaatggtgcagatagaaaaaatgccccaagaatttgaggacgcccgtgcagtcctacaaaaaatcgaagatgcaggttttgatgctttttttgttgggggaagtgttcgtgatacattattaaataagccaattcatgatgttgatattgcatcaagcgcataccccgccgaaattaaacatatttttaagaaaactgttgatacaggaatcgaacatggtacggtaatggtgattcatgatggcgaaggttacgaggtcacgacttttagaaccgaaagtggctaccaggattttcgccgtccagatcaggttacttttgtacgctctttaaaagaagatttaatgcgccgtgattttacaattaacgcatttgctttaaaagaagatcgaacggtaattgacatttttgatggtttaagcgatctagaacataaaattattcgtgcggtaggagatccacacgaacgttttcatgaagatgccttaagaatgatgcgagcagtacggtttgcaagccaactagatttcaaaattgaagcaaagacgctgaaggcaatcgaagaaaataatatgcttttaggtaaaatctcagtcgaaagaatcttagttgagtttgaaaaaatgatgttgggtagcaaacccaatcgtggactagaagacatgctaacaactaaattgaatgaatattgtccgggatttaaggaccgttctaaagaactagaccagcttacaaaatatcccttggaacttctagaaaattctgaacaagtttggattatgattgcttggagtttaaaattaactcctcaagaagtaatgcctttcttgaaacaatggaagacatctaacgatttgatcaaaaatgtcagtgcgactttacaagtattaagcatggataaaaatgatcaaaacgaacgtttagcgctgttcaacgcaggtgaagctaatgtagttagcgccgttcgggtagcccaaattctagggatgaatcgtgaggcttggctagatacttaccaaaaccttcaaattaaggatacacatgaaatggcaattactggtaaagagctaattcaaaaaggaataattaagcctggacctcagatgggacaagttttaaaccggttaaaattaatggttattaatgatgaactgaaaaacgagtccttagcgcttttgaatgcagtaaataagttacagaaagatgattaaatatgaaaatactaaaaggtaagaatctaaccaaaacttacggtgaaaagaagctgtttaactcgattaattttgtaatcaatgaacacgatcgagttggactaattggaactaatggatcaggaaaaacgaatttacttaatgccgtttcgaatcttgatcccgctgattcaggaacaattgaaacaccaaacgattaccgtattgcatatcttaaacaaagtgaagaaattagtcagtttgaaacggtacgtgaatttatttacagcggggatcaacatgtatttcaagtaattaaacactacgaagaaatcttagaacaatatactaataatccaacttcatcaacgctatttgaaaaatttactaaacttgaaaatgaaatgaatcaactggatgcttggaatacggaaagtaatattaaaaccattttgacgcaattacacgttgatatgctagatgaatctatccatcatctttcgggtggacaagttaagcgaatcgctttagcacaggcattgttagagccggcagatttattgattttagatgaacctactaaccatttagattttgattcaattgagtggctggaaaaataccttgctgattataaaggtgcattactattggttacccatgatcgatatttcttagatcgagttaccaatcgaatttgggaattaagttacggagacctttttgagtacgtcggtaactatgaaaaatatgttgaacaaaaagcggttcgtgatgagcaaaacgaagctagtaaacaaaaagagtacaaactatataagcaagaacttgaatggatgaaacgcggacccaaagcacgtggaactaaacaacaagcgcgaattaaccattttgaaaagttagaccaagctgtacatgcgcctaaagaggttgatcaagaccttgagattggtctaacacaacaaagattgggcaaaaaagtaattgaaatcaatgacttagatttagaagttggcgaccatcaaattatgaaagatttttctaagttaattcaggcgggtgaccgaatcggaataacaggagccaacggtgcaggtaaatcttcatttttgaatgcgattgcgggagtattgcctattcagggtgggaaaattgaaattggcgaaactgtcaaaattgggtattatacccaaaaaattgaacccataccagaagataaacgggtaattaattacctaaaagaagttggacaagaagtaatcaataaagatggtgaaaaaattagtgtcactagtcttttagaacaattcttatttccaagttttctacatggtagtttaattaaaaagctatctggtggtgaaaaacggcgtctatttttaattaaaattttaatggaacaacctaatgtactattgttagatgaacccactaatgacttggatattgctactttaactgttttagagagttatttaaaaaccttcaaaggtacagtccttaccgtgtcccatgatcggtatttcttagataaagttagtgaccaattactaatatttgatgggaatgctaaagttgaaaaatatacgggctcgatcagtgactatttaaaacaaaacgtagtacaatcaagtaaaattaaaagtactcctaagtcagttgaacaagttgaagctcctaaaaagaaaaaaaggacgtattcagaagaaaaagaatggcagacaattgaaactgaaatcgaaaagttagaacaaaagtccacatctgtggaggaacaaatgagcgaatgtgctgctgattacggaaaattagcagaattgcaaaaagaattaaatgaaatttcggaccaattagaagaaaaaatggcaagatgggaatacttagaaagtttcgaagaataggggaaatttaatatgcttgaagaacaataccttaatttggaaagatatgttttggaaaatgggcatctcaaaggagaccgtacccaaactggtaccctaagtacttttggatatcaaatgcgttttgatttaagtgaaggttttccattactaacgaccaagagagtcccttttggtttgattaagagtgagttactctggtttttaaaaggcgataccaatattagatatttacttcaacataataatcatatttgggatgaatgggcttttaaaaagtgggttgaaagtgatgaatatcagggaccagacatgaccgattttggtcaccgctcactgactgatcctgaattcaatgaactctataaaattgaaaaacaacgttttacagaacaaattttggaagatgatacattttctgctaaatatggtgatcttggaaatgtttacggtagccaatggcgagcatggaagactagtactggtgagactatcgatcaaatttcaaatgttattgatatgattaagaataatcctaactcaagaagaatgattgtttcggcttggaatcctgaagatgtgccaacctcagcattacctccgtgtcattcactatttcaattttatgtggctgatgggaaacttagctgtcaactgtatcaacgcagtggcgatattttcttaggaattcctttcaatattgctagctatgccttgcttacagaattaattgcgaaagcgaccggtttagaagtgggagaatttatccataccatcggtgacgctcacatttattctaatcatctagatcaggttaaagaacaattagaacgtactccacgtccggctcctaaattgaaatttaaacaagtgcatgacagtatctttgactatgaaccaggagatattgtggttgaaggatatgatcctcatccaaccattaaagcgccggtagcagtttaattttaagtcaatttaggaggaattaaatttgatttcaatgatttgggccgaagatttgcgtcatggaattggtaagcagcaatctattccgtggcatattccaggtgatatggctttttttaagaaaaccactagtgggaacaccgtagttatgggtcgtaaaacttttgattcaattggaaaagcgttgcctaaccgaaaaaatattgttttaagtcatcatccaacctcattgccagattctgtagttggcgtgggttcattaagtgaacttcaagggatttttgaaacccatcttaatgaaaaattttatattattggaggaagtcatttatacaatgccttgttatcacaagctgatgaacttctgataactagaatccaaaaagattatcaatgtgaggttttcgcacctgatattacccaaaatgaatttaaattggctagttcagttgaacatgaatcaaccgaaagaaatcctgcatatacttttgaaacatggattagaagttaataaacgttaaaacctcatttattgaggttttttatttatcctccttttcaaaattaaaattatatgatatatttaatctaatttttaatgttaggttatctaacataagtaggagggcatcatggcaaagattaaaaaaactttattgagcatagtttttagcattgtaattttatttgggtggtcagtttttaattcgaataacgtcaatgcggatgagaaagtgtacgagattggaactgatgttacatttccaccgtttgaatttgctaatgatcaaaatcagtacgtagggattgatatggatatcattaggacgattgctaaaaacgaaggttttaaagtgaagattaagccggttggtttcaatgcagcggttcaagcgcttgatgccgggcaattggatggagttattgctggaacaacgattactgatgaacgtaaacagaagatggatttttcggccccatactttaaaactggggtggtgatggctgtaggacaaaactcatccatcaaaaatttccaagatttaaagggcaagcgagttgctatcaaaactggtacagctgctggagactatgctaaaagtattcagaaaaagtatggattcaaaacggttacttttgatgattctaataacgtctataacgacgtgacgactggaaattcagtggcatgttttgaggatcagccggttatgcaatacgctattaaaactggggcaaaacttaagatcgttactaaaccagccaatggcggtgcttatggattttctgttaaaaaaggacataaccaagaactattaaagaaatttgatgcgggtttaaagaaaattaaaagcaatggacagtataaaaagattgtagctaaatatttaggagcttctgctgttgcttcacaaaaagctcataaaacacaaaatacatttattagtttatggaaacaaaatcaaggcgcattacttggtggattagaacaaacggttattttaacagtattatcaattttctttgctaccatttttgggatattcttcggaatgttaggggttgtcccaaataaatttgctaatggagtttcgactactgtaatttatattttccgtggacttcctttgttagttttagccttatttatctatacgggggtgcctaatttgttaggtgaaaaaattccagcatttgttgctggaattattaccttaaccttaaatgaaggagcttatactgccgcttttgtaaaaggtggtattgaagcagtagatggtggacaaatggaagcagcacgttcactgggattaccatatggaaaggcgatgcggagagttattttaccgcaaggattgaaaattatggttccatcctttattaatcaatttattattactttgaaagatacttcgattctttcaattattggaatacttgaattaacacagacaggtaagataattattgcacgtaatctagaaggatttaaaatttggaccatggtagcactaatttacttggtcatcatcacattactaacgtggctttcaaaatgggttgaacggaggatgaagggatgagtacaaaaatagaagtacagaacttaaaaaaatcttacggtagtaacgaggttctgaaaggattagatttgatcgtcaaagataatgaggtggttgttatgattggtccgtcgggttcgggtaaaagtacttttctacgtacgttaaataagttagaagaaccgaccgctggaaaaatcattatcgatgggcatgatttgaacgattcacgggttaatatgaatcaggttcgtgaaaaaattggaatggtatttcaacactttaatctatttaataatttgaccgtaggcgaaaatgtgatgttgtcgccggttgaattagggaagatgagtaaagcggatgccgagcttgaggcacgtgaattgctaaaagaagtgggtttagaagataaatttaatgctaaaccccaatctctttcgggggggcaaaaacagcgagtggccatcgcaagaactctagcgatgaaaccagatatgattttatttgatgaaccgacttcggccctagatcctgaaatggttggagatgtgttagcagtaatgaaaaaactagctaaggcagggatgaccatgattgttgtaacgcatgaaatgggctttgctaaagaagttgctgatcgtgtgatttttatggcggatggtcatatcatggaagaaggaaagccggaagaaatttttggtaaccctcaaaacgaacggacacaagaatttttaaacaaaattttaaacgtttaatcaataaaagggcttgaagtaaaaataatatttaacgaggttaaatattatttttatcaaggctctttttaaatacaaaaattttttgcggaaaagtttgtttatagaacaaaaatttagaatagattgttataattaaaattgtaaatatgtacggggattctataaatgtatatgaaacacgcttcatgtgaatagaactcggaataactatgtaacaaggaaagagtgaaaatatgagtcaaattaaaattgtcacagattcatcatgtggcgttactgatgaagaaattaaaaaatatgatatttcaattgtcccattaagtgtaatgattgatgatacagtttatgtcgaaggtgaaaccattactaatgaagaatttattcataaaatggcatcatctaagtcactaccaaagactagccaaccaccattaggtaaatttgttgaaatgtttgatgaattaggtgaagatggtagccaaatcatcagctttaatatgttagaggcaatcagtggaacggtacatactgccgaacaagctgctcaacttagtaaagcagatgtgactgtgattgatagccaattcacggatcgcgccttagcttttcaagttttagaagcagctaagatggctcaagaaggtgccagcaaagacgaaattatccagcgagcagaatatatccgagatcataccaaactttacttaagcgttgttaacttggaaaacttagttaaaggcggtcgtctaagtaagattggcggaatgctgggaggtttactaaatattaagttattacttgaggtaaaaaatggtaaacttgatgtagccggcaaggttcgcgggatgaaagccatgaagaaactttggtcagatatttatactgaaatgcaaggtagtggcaaaatcaaaggggtaggaatttcacatgtagaagcctttgatatggtagaagatatgaagaaacatgttggtgaatttttcccagttaatgatattgttgtacgagagactgttccaattattgcaactcatacaggtatgggtgcgttttgtatcttatattacagtgaagattaaaaagtagggcttagatcgggactaaccgattttggccctaatttattttacagagagaggcattatgaaagtagtcagagaaattttatttagtatcattggtatttcggttatcacgcttttaattttatgggggttgggattttttaaaggagctaagacaccgtctcaagttgctaacaaagtcgtaccgacaacccagaaaaaagttaaaaatcttaagattttagcattaggtgactctctcactcaaggagttggcgatacaaagaatcaaagtggatatcagcaacgtttagctaagaaaattactaaaactaaacagataaaaaaggcaacgatttacgatgagggggttagtggtgaacgtagtgatcaaatccttaaacgcttcaaaactactactaaaattcaaaaagaggctgctaaaagtgatgtacttattgttacggccgggggaaatgatcttttccagaatctccagaaagatgttactgaatcacctagtcaagttgccgtaaatgttaatcgtattagtcttacttatcaagacaacttagaaaatatttttaaatatgcaagaaagctgaatcccaaaattaaaattgttatggtaggaatttataacccattttacgtatatttcccaaatgtagtggctatcacagatgcgataaatacatttaataccacagcaaaagccactggtgattattttaagcatgctacttttgttgatatcaatgcattatcagtgggtcaatataagacgcttagtcagcagcagcgcttaaagaaacaaagtaccgaggatgatattgcggttgttgaaaagagtcaacttgagaaaagtaaatttgatactaaagaaaaaaataattatttatcggatgcagatcattttcatcccaacgacaagggatatgatatgatggcagataagatctttaaggccatggatcgggcaagaattttcaagtaggtgaagaaatgaataaatatatgtatcatttttggaaatggggatttttagtcctgctctccatttttttagcgggcggtatttatgtaacttttaaagcttctcgtccaattcaacaagttgatgaccaagtagttcgaagtagtaaccactatgatcgaattccaattaaattgaagaaaaatcaaattaatgatttaagcgcagcttatctttctcaatttcaaaaagatgaggattttaattatgggtttaaaattggtcaacgctacgctattttaagcggagaaactgaaattttaggtaaaaagattcaatttgcgttaacgatgattccaaaggttaccaaaagtggtaatatcaaacttaaagcgcatgggctaacagtgggaacgttaaatttatcagctaaaattgttttgaaatatatttcacgtaattatcaacttcctaaatgggtaagtattgatggcgatgaagcacttttacgtttaaatcagatcaaaacaactaataaagtcagcttccaagctaaaacaatcgatattgataaaaacgattttcaattcataattaacgttcctaaagccaataattaaggagaatgctaatgaaaaaatcattttttgaatatttaatgacacaacgcaatccgcaacctaataatgaagttgaagaatttgctaaccaagctttttttgatcaagtatttcctaaacaatcacgcgattttgatgagatcagtaaatatttagagctcaatgcgggctatctacaaagtatgtcaatttttgattcagcgtggcaaagatatttagaaagtgaacagttttaatgaaaaaaataatagaaaaacatccgtatttaactatcgtattttccatgattttaggagttttaattactattgtcagtggtttagtattttttgtagggattttgggtcatactgatggtgagaaaaatgattttaatcgtgtggcgagtgtttataatcaaattaatagtgattattataaaaaagtcgacacttctaaattagctacaggagcaattgatggaatgttgagcactttaaacgacccattttcggactatttaactgatagtgatgctactagtttgaatgatagtgtttcaggagccttcggtggtgttggtattcaagttgtaaagaagaatcaccaaattgaagttatgactaccattgatggtacacctgccaaaaaagcgggtctgaaagccggagatgtgattttagaagtagatggtaagaaattaactaatcaatccctttctaaagccaccaccttaatgcgaggaaaagttgggactaaagtaaaggttaaattgcagcgaggaaatgatacctttgataaggtgctaactcgttctaaaattccagttgagaccgtcacggctaagatgttgaagaataaagtaggttatataactatctcaacagtggctgaaaaaacttctagtgaacttaaacgggcgcttaaacgtttggataaacagggagctaaatcttatattattgatgtccgaaataatccgggtggcttgatgcaggaagctttaaagatgtcttcgatgtttttaaagaatggcaaaactattatgcaagttaaagctcggactggtaaagcagaagtatacaaggcatctaagaagtatgatggtggctataaagttactaaacctactacagttgttattaatggcgaaagcgctagtgcggctgaaatttttgctgcagctttacaccaatcggctaatgttccacttgtaggttccaaaagttatggaaaaggcaccgttcaaaatattacccaatatacagatagtgatgaattaaagttaacgattgcaaaatggctaacgccaaacggtacttggattcatggaaaagggttaaaaccagactatcaggctgattatcctgccatggcatacattacagaatttgatcagaaaaaaacgtactccgtgggagagagcaattcagatattaaaaatattcaaattgccttaaagggattaggttactatgatgataaaatttctaaagagtatactgagaaagttaagcaggcagtggaagcttatcaagaaaagaatcagctggctgttactggaaaagttgatgcgaagacaatgcgttcaatcgaacagaatgtcattaaaactttagctaaaaatgatcctgctctagaaaaagcgcaaaaagttgtgaatgacgaaaaataaattgatttaaggccctacagttgtagggcctttttgattggaatttttgaactaatttaaatatggtaacgttttattcaaactttctaacaaaaagtcagcatttttaacagtttttggttttaatttacggaagatagtagtaagttaaatatatctgttttaatcatagtatgataggagttttgagtaatggaaaaagaaacgcggaaaaattacggggcagcagggttgcttccgctactaatttttttgctactatatgttggatgtttagccgtttttacaattaaaggcgctaaagatccttcttcatacatgccacgccaagtggccattttaattgcattagtatttgcactaatattttttgaacctcgcagtaaattcagtaaaaaaatggacttatacctaaataatgctggaaatgcaggggtgatgaatttagctttaatcgttatgatggccggtggtttctcatccgccgtaaccctttcagggggacaatcctcaattgttaatttaggtgtttccttgattcctagtcaattcttagttccaggtatctttttaatttcagcaattatttcgctttgtattggtacctcaacgggaaccatcgttacgatggcacccgttacattttctctggtagccgctgcccatttgaatgcagggatggcaggagcggctgtaattacaggatcatattttggtgatgggttatctatgattggtggaactactatctcggcagctgctggagttggttcacctatgaaggataaattcttgtggcaaattaaaattgcgacaccagctgcaattttaactattatcgcctatactttgatgagtttaaataatggtggtgcccatcatgttgccgccggaagctataatattattacaattttgccttacctagctgttttagtgttagctgccgtcgggatggatgtggtcattgtactagcgttaggaacggttatggcaagcgcaattggaatttttcttggaaaagcgaatatttttgattgtgcgaaggcaattggaaacggaatggaaagcatgttctggttagctatttttgcaatgatggtcaatgggatggttgcgttaatgcgttattatggtggaattgactggttggtgcatgtctttactaaacgtattcatagtaaagctagttgtgaagctttaattggaatcttgagtttctgtgtaaccggagcaattgtaaataataacatttcagttctaattacttcacccattgctagagaactcggtgatgaatataaagttgatcgtaaagtgttagcaggaattatttccatcttcgcggtaactgcctcaatggtaattccacaagactctgcaatgatgatgactcttcaattagccggtaagagtactaattatctggatttggttcgttatatgttatacccggtaatcttgatggcactaacatttgggattaattatttttcagccaaaaagagcactttaagtaaagctgaatagttaaaaagacgattaggatcgtctttttatttttaaataaaataaatccagaaagagttttatttctcttactattactaatactataaaaattatagtattatgaatgcaaattgaagtttctcaaattttattttaggaggacacatgacaactttttattgttattctaagtgtagtacatgcaagaaagccgaaaaatggttacaagaacatgacgtatcctatggaaaaatcgatctagttgaacaaccaccgactaaagaacaaatgctaaatattttttccaagagtaatcagaaattacgctacttttttaatactagtggaatcgattatcgcaaaatgggacttaaagataaggtagaaatgatgacgaaagaacaggctgcaacattaatgtccaagaatggtaagttaattaaacgtccgttaatggtcgacgatactaaagtcacttgtggatttaatgtaggagtgtatgaagagaattggatttaatataatgaaagacacacggttgtactaaaaataagagttggatttctgtagtttattcagaaattcaactcttattttatatggaatacgattaattaagacatcaaaattctatacaccaactagttcgactataaaatttttgatatggtagcaacacaattgaagacaaagattcatcattacttggtggaaattgggtctctaaagcaactccaccatattggccaatattctgtgcaaatccactattattaaaatggttaccagtataaacaacaattgatggggcagttgtttccacactcaatctacgctgatgatctaagctttctaatactgctgcaatattattatttcggttgagcaagaaaggatgattaagtcctaattgttctcttatttgtgaatctaaagaagtaattgctttaccaagtaatttgggttttcgaaaatcaaatggagtattagtgactgatttttgttcgccggttggaatactatttttgtccagtggtaaataatagtcagcatctaaagttagatattggtctagtatatctttaccgctatttagattaaaatagctatgatttgctggattacataaagtttttttatctgaaatagcttctatttcataaattaatgtattttcgtttgttaacgtgtaagttacataaatgcttaaattcccaggatagttattataattatccggatctaatagatgtaatttaaggatactacagttttcattttctttaatagtaaagccgaacacttgcgtatcgaatccttttgatccaccatgcgcatgattagggccatcatttagttcaaattgtattgtgttatcttcatcttgccagtgaccatgtgcaattctgccaataactctaccaacagtaccaccgagataattccgttctttatcataatattctgggcgttctaaacttaaaatgatgttgtccttttcagatgttcgatcaggtacaaaaaaatgttcaagagttgcaccataatttaaaacatcaacttgaacaccatttttattaaacatagaaatacgatagtaatttttatcatctagtgtttggtatttattaactaaagtatgtttcatttcgaaattcctccaattaataaaagcactcacatgagtacttttatattataaactaaattttttgaacgaatagtgtctgagtatcccttgatgattattagtcaattcagttattttatccatcattgtatgagctttatccacttgatttaatccgaggtatcctaatgcgattaggtaataacagtctatgacattaagtgacttatgatcatctttgaatagcagggcatcaggtaatgatacagcgaagtaatccatttcgaaattgtcgaaaatatgtttttcaccataactaattaatgcgtgaaatttaccatttgcttcttttgtctgacctaattgttcaaaggctaatccttgataaaaaatcgtatctgatggttgatcgttgtaatacatagcactagatggtttttccaatccttgagtagctaatctaagatgctcattagcttgttgagtatcgttaatttgtttgtaagcataacctaggtagaaatcgataacattattgtttgccgtaggaagttttccttcacccagtgagcgtggataaactaaagcacgattaagtttttcaattgcagtcgtataattttcgttagcaatatcttgttttgcaagttcaactaatgcatattcgtattgtgagctgactttaccttcgccaccttcccaagggtggaagatacgatccattaacttttgataagcttctttgtatctaccagtttcgtttaataaagtaactagttgaatgtagctatcgtcgcgttgctcgaccagatccaaatgtttttcaagaaaggctaggcgatccgttaaagaatggttcattttttgatacaaagaatccagttcaaaaacaagccgtgcatttttaggttctaatttaaatgctttttctaaatattctaaggctttcttaggttggttagtcttgttgtagtagacgattgaaagattccggtaagacattgcgtaatcaggatcaagtttgactgatttttcccataaagcctgagctttttgatatatacgacgatcatagtataaattaccaagatagtagggtgctaagccatcttttggattgatattttgaatatattccaaaatgataacgtcgaacagacgatttgggaagatatagtctggagatagactagctccaagttttgctgaagcaagaacttgttcttgtgaatccaatttagagtatatataagattcataataagattttaatggattatcatctttgtaaatgttcaaggccgataatgcatcagcatattgtccagtttcaaggtaaagttgaactaaatctaaaacatcatttaaacgagtatcaatgaaatgttttaacgtatctaagtaatctggattaatttttgaatattcgaataataccgctgaagcactattatcaatttctaaactatcttttaaaaatttttcagcttgatcggatttcatcaaaattaaaatatgagccttgattgctcgagctgttaaatcattatagttaaataatagtgcttgattaataaatttaagagcattgtctaaatcattttcgcgaatctttattttagccattgccacaaaactaactgattttgtatctgcagaccaagttgctttgtaaaaagcatcgtatgcttcagcgtattttccttgtttttcaagacttagtccaagatgataacttgggaaaccagatactgggttggtattatgattgttttgacgttctaaagcacgtctaaagtatttttcactttctacaaataacccttgacggtagagtaggagaccgtacgcatcattgattcgtttatcaaatttatcccgtttaagtccttctagatagtagttttcaggtctgaaactagcgtgacgatattgttcaagatgttgtcctgcattgaatagttcatcgttagttttgatatctttaggattaggaattgctttggcagcatctggaattgcttcgattttttcaggttcaggtgtatattgcaccaaaacattttcgtcttgatcaagtacttttaatgttaattcatgcaattcaaactgatcattttgaatggttgttgtaaacgtttctgtggggcttaatgtagttttttcgttaagtagaacttcgtcttctttttccaaaataacttgtgcatttgaaaatactgatgttgcatatgctgcaattaaaattgtatccccatctttttccaaattaaccgcggcattgatcgtagcatttttaactgctcccacagctttataaggcataaagtattcagtactatgtttctcttcatgaggattgagccaagagaagtcgggctgattatctgtgaaagtaccaaccatcaattcgatgtatggtccatcattatcggttaactgatgatcccaagattgtccaaaatcaccatgtccccaagtccattgctttttaccaggtgaagtatgatggtcagccacatgaagaagaccagcttctttctggtgatcgtaattacctaaaaagtcgtattttgatttggctgccatataagaagtaggtacaggtacatttttgtaacgagaaatgtcaacgccttctgagtaatcaactttataatattcaccagttgcgattggaaaatcagatactgcacgttttccgtgatcaaaaacagcattaacatctggtggaaagattgattgagtgttttcatttacaggtactgcgggattagcccaccacaagaaagtctgtggtaaatcagttggatttgaaaaagtttcatcaactttcaaatatgccttatcaggatacatagtgaaaccaactaaaatttttgtgccattcatttgatctatatcactcatccagattgttttagaaccgtccgagttaatcttagtgtaataattcactggagaaaaagtatctggtcggtgatgttgtggccaattgaattcgattcctccggaaatccatggcccagccagaccaacaagtgctggcttaataacttgattataatagacaaagtcgtaattattagttttatctaacattcgataaattcgtccacctaattcgggtaggaaagtaacctggatatacttattttctaagataacagctttatatgtcttgtcatgtttttcatcaaagacacgttcggttaccggaaatggataagtcttaccactacttccttgatatactcgatcttctaaaaacatcggatttttttctggcttagcgattccataggttggaatcgttaagtctgttttttttagaataactggttcatttaacgtaatatcagtagtcatataaaacagctcctttcaaatttacgttttaagggtataatagaaaacgctttcttcaaatgtacaaaatgtgctaaatgatggattttaggcaactgttatttgtttaaatttttatcatatgataatatcgagaccaattaatgaagagattttataaaggaggggcttatgaaaaaattacacgggtttgagaatgaatatttatctgtattaccgccagtgattttgaataattttaatttttcaaaagtcataaagctgttatatataaccgatctcggtttttatcctaaagcaagatatcattttgttcaccgtgatcgtggtactgaagaatggatattaattttttgtacacatggcaaaggagctgtaaaatctgcgactgaggaatggctaatcgaaagtggatcaattgttttgttacctcctggtaaggaacatacatactacgcttttgatgatgatccttgggacatattttgggcgcattttaacggagattctgtaaatgaatatattccacaagaagctttgcaaggaaacggtttcttagtgattaataaaacaagtactgaagatatgcaaatgcttatgtcacaattttggcaaatgattcaagcgttatcagcaggattttcatatcaatcagttttttactcatcacaggtattaggtgcaactttagcgtatgtatcgttgcagtcagttttgccgcatgattcttatacaatgggtaacgaatatataaccaaagcagttaaatatggacaaaagatcagctcctaaaagatgggtttgtggtaaacaccattttaaaggaagctgatcttttttgtccgaacagcgttcggattaattttacaatctaccccttaactacagtatagagaaattagtggttaattgataatgatatgcgtgggcgttttaaaaaatagttggcactagtccgccatcaacccgcaatgcttcaccagaaaatgacgatgcatctggactagcaacaaaggctgcgaaacgaccaatttcttctggacgaattaaacgttgaatttgagagcgggaacgatgttttttcataaagtccgcttcccattctgatttaggtaaatcactatcagcgtacatatcttctagcatttgctgtaccccttcagttaatgtcgaacctggcattatggtattaaccgtcacatgtgtagcaaccgttagtttcgataagctcttagctaacgacaaattcatggtcttagtcatgctgtattgaggcatttctcccgatggcatcacggcttcttcgctagcaataaaaatgatccttccaaaatcctgatctaacattttaggcaagtaaaatttagctaaagcattcccagctaatacgttaatctggaaaaatttattccatgtagcatcatcaatatcggcatattccatcggttgaaagattcccatgttattgattaagatatcaaccttgggatactgctcaaagaggtgtgttcgactagcttcattggcaatatcagcagctgcaccttgcggattagtatttggaaattgggttttaatatcagccacgacttgatcaacctcatcttgattccgtccgttaatgattacgtcagccccctcacgggctaattctgtagcaatggctttcccaatccctttagttgagccggtaatcaaagctaatttatgtgttaaatgtaaatccatagtttacctccttctaaaatctaaaaatcaaattcatctgggttaggtccgacgcgcaagttttcattcaaagcattaatttggtccatatcttccggtgctaattcgaaatcaaaaatctgcgcgttacttagcattcgttcggcacggactgatttaactactaacaaaatattttgttgaacatcccaccgtaggacaatctgagcgacagacttattgtacttttgggcaatcttagctaacacagcgttatctaagatttttccttgcatcaaaggtgaccaagcttggaccttgatatcatgtttagctgcatattctcgcatctcgagctgacttaattgcggatgggtttcgatttgattaattaccggtgtaatttcagcaaattccgctagagcttggagatggtgaatttggaaattacttacaccaatcgctttaatctttccttgtttatataaagtttctagtgcacgccatgcatcttgaaatgcattatctcctggccaatgaattagataaagatccaaataatctaaacctaacttctttagactgctctcaaaggctgctatcgtttcatcgtacgataagtggtcattccaaaccttagaagtgacaaataaatcggctcgcttcaaaccagttgccgccaacccggctttaatgcctgctccagttcccgcttcatttccgtaaatctgtgctgtgtcgattaaacggtaaccatttttaatttcagatgccactacttgagccgtatctgcatctggaatttgaaaaactcccagacctagccctgggattgcagttccattatttaacattatgcgatcgtttaaagaattaatcatttttttctcctttgaagttcgattataattttaactataactaaactgtttctattcagctagtacccactttattgtgctatacataccaaaaagtatgctttgtgttatactggcaaaaaaggagcgaaactttatgacaaaacgaatttataatattggtgtggaagcgacaatggatgttatcggcggtaaatggaagcccatcatcctatgtaacctccgccatggacaacaacgtcctagtgaattacggcgtaatatccaaggaattagtcaaaaaatgttaacccaacaacttcgggagttggaacaggataacattgtagttcgtaaatcatacaacaccgttccacctaaagtggaatattacctaagcgattatggaagatcgcttgaaaaattgctcgacacattgtgtagttggggcgaaatgcacgttagcactttacaagctaaaggtgaagacgtagcactcgtaaaagtcgattaataaggggtgctaaattatcggtactgctctgataattagcgctttttttatttcactgataatttattaaataaaaaattatctcgtaacattaattggtatattccattatattttttagtaaaaataattaaaatgtcatcatatttatcatttttatgtcattttttagttatatatcatttgtaagggtttacattaatgatttttatcactatactgtttttgttaccaaaatataaaggaggagctttttcatgaataaatttatggactggttacaaaatgtcctaatgccaccacttgctaaagcggggaataataaatatctggtttccattcgtaacggactagtattaaccctaccggctgtgattagtggttcaattttcttaattattgctaatattccaatccctgcctggtcgaattttatgaaaccatacatggacgccatgggagttgcagttaatggttctttcggaatcatttcattgttagctgccatcggaattggttacgaattagctaaagctttggagttagacgctatcaatggcgctggactttccacgatggcttttatcgtggcttcattcaacagtaaatacaccctcgatactgtaaacttcgcttcgtctggtttatttacagcgattgtttgttcatttatttctgtttcgattttgaacttattcgttaaaaaagactgggttattaaactgccaaagggtgttccagctgctgttagccaatcatttgcttcattaacgcctggttttgtagttttgctattattctggggtcttcgagttccccttcattttgatattaatctatttgttcaaagcatcttccatcccctattatttgctatgaacagtctaccaggaattatgttctacacgttattggttagtatcttatgggtagctggtattcatggtgatatgacgttacaaggaatttcagatccaattttccttcagtttctaacagctaatggtttagcttacgcgcatcatcaaaccattccatacttaacctctcttggattttctagtttatttgttaatgttggtggaaccggtgcaaccattatgcttgtattttggatgctttcatctaagagcaaggcttatcgagaacttggtaaagttgcctttccaagtgccttatttgaaattaatgaacccgtaatttttggtttccctgtggttatgaacccaatcactttgattccattcatcatcgttcctcaaattttaacggtcctaacctacattttgatgagcgtccatttagttcgcccagccgtaatgatggttccttggaccatgccaccaattatcggacctttaatggcaactggttgggattggcgtgcgggagtttggtcggcaattgaactagtcattgccggagcaatctactatcccttcttcaaggtggctgaaaaacaaatggttgcccaagaagcaagtgaggcttaaactttcatgaaaatcaaaattctattaaaatatagtgtagtaggtgccatcttgattgcagctcttgctattgcgatgacccaacttcatttaacttcaaccctaactaatcgagtagttgaaatcgctggtataatagtatttgtagtactaggagcacttctaaaacgaaaagcagttaataaaaattaatgaggcccaacgacatggataaattagaacagttaacccaaaaagatttggaagaattttatcaactatacctgtacgcctttacgaactcagattcaaaaggacgacgagctttctttgatcatcgctacaaccatgctttaaaatatggaatcaaacataacggaaaactcggaagcgggatgttaagtattccatttcacgttaactttcatggtgtgaaatacaagatgaatgggattggcgatgtcatgagttaccccgaatacggcggtaacggagcaattacccaactcatgcaacaagcttttaacgatatgttagaagacaacgttgctctctcatatcttgctccattttcatacgatttctatcgtcgttttgggtatgaagaagtttttgatcgtaccatctatcgggttaaaaacaccgacttaccgagagtaaagattgacaaaaagattggtagtattgaacgtttaaccttagccgaagctattccatttattaaggaagtttatgctaataatcccaacagccacaatgctggtttaattcgtgaggattggtggtgggattatctcgttctcaagcatcctcattggcaggtgggcgtctacttctctgaagaccatttatctgcggggtacgttatctacgaggggcttgatactaccttctcgattcaagaaatcatgtttactaattgggaaagtttccaatatctaagtcgctttatctgccaacatgagtcgatgttttcaactttcgaatacgccagtggtgaccctttaggccatcctgacattctaaagaatccatccaatgttgaagttcagattaagccttacatgatggctcgcattattacccttgagaccttcattaatcactatccattcttaaagaaaatcaaaagcactcgtgttgcagttactgataaaatgcttccggctaataacggaatttggcgtcttttaatcaatgccaatggcactagctttgagaaaattagtgataacgaaaataatatggctgacattcgtatatctattcaagaactcactaaagttttattaggttatcgttccttaaatgaacttaatcgaattggagcgattcgcggtagctatgaggctatcacaaatttagacgctaccttacgtaaagaaccacctatgctatgggattacttttaaatcaaactttaaaaaggcaaaccaacgtcagttgatttgcctttttatcatttttcagtatagatagaacggagattatatctaatatatttttcaaaaaagtttactaaatacgtcgtcagctgctttagcaatggaaaagcgcctaatccgattgcacaaagcatcaatgtcagcgggatttgatacaagtttaaactaacaggagttacccatcccatcatatggacaaccagccattcacctactaataaggctggagacactataaagccgatgatggagatccaaagaccacataagattccggcaactgccaagacaactcccatggtgacaataacgttgaaccagaaaaaaccaaataatgctaaccaattaatttttttcattttatgacctgcttcctctttcgaattagagggatgcattgcaaccaattggtcgagcgaaacattatacaactgcgcaagatcttttaaagcatatatatttggcatcgtttttccttgttcccaacgtgaaatcgtttgtctggtaacatacatttgtgtcgccacttcttgttgagtaagatctcgtgctcgccgtattttttgtaacgttgttccgattgacatccaaccaccccttctagttctactctgccacagtccttttaaaagccaagcaacaaacctgttacatggcttaaaaatcaagttttattaacttcattttattccttttgaagttaaatttgggtaaaaaaataatgatagaaaaaatttctatcatcatttttattacttataacgttgattcttttaaaacaccatcgttaatttcgaacatttgatcagcatacgattttaagcgcatatcatgggtaacaattactaccgctttatgacgatcgtgtgctagatccgcaaataaacgaccaacttctttaacccgttcactatccaaagccgctgttggctcatcagctaagataatggcaggatcgggatacaaggcccgagcaatcgccactcgttgctgctgaccacctgataactctgttggaaatttatcaactaaatcttcgattcctagttgttgcaataatttatctaaactttctttagataaattaccttctttttttactttatcgaccaatttgaattgatctttaaccgttagaaatggtaataaatggtaattttgtagaatgaaaccaatgttattaagtcttaatttttcaaggtctttacgggaactagtttgataatcttgtccattcactttaacttgtccagtagttggagtccgcaacccgcctccaatggttaagaatgtacttttcccagaaccactgggaccaataatcaagctcaatgtcccagcttcagccttaaaattaacgtcatgtaatacgtgaactttagcaatcccttttccataaatttggttgatattattcatttcaattgcagtcatcatttatcctccaattacacttactgggtctagttttagtacacttcgtattggtaacaagccccctaacagccctgtgattaccaatcctacggctactgatgcaaggattggaatatcaaatgccattggaactgcagcaggtaaaatagcagctgtagcagctgttagagccgttccaataatggttccactaatcaccaaaattagtgattgagctaacgtgctccaaactaacacgctacttggaattccttgagctcgtaaaacggcataatttggaagtttttgaatggtaaggatgtataggaagatggcaatgacgattaaagaaatgaccattaaaaatcctatcatcagtgagaaggtcatattctgagctgagtaacctggaagcttctcaataaaggatttaactttgtaagattttagcggttccttaacctttaaattcttagttttagaaacaattgcactagccttagtctgtggtgtagcatgcttgagcgcttgccaatcggataatttcccataaattactggtgcaatatttaacttcgcattcttagtaaaaccgacaattttaaatgctttatctgcatcattcaattcgattttatcgccaagtcggtaaccactttgttcgaatttttcatctaccactacttcgtggtcttgcttcactttatgcccactagtaagtttcaagtctttagcaatgaattgatcattatcaattccaacaaaactagaagaaatcttagcctgcttccccttttggtctttagctactaccgcaacttgtccaatcaaggcatcttttttagttaatttttggtcttttacttgttgatcagtcaccaacgactgacttaaattaacgttggcatcttggtttaaaactactgtttctactttccaggagttaatggcatccgtattttgatgagctaaacctagtgctaaactagttaaaataaaaattaaataactaatcaaaacaatcattccgataattagactgtatcgtaatttttcttttttgatttcttttaaagctagaaacataattattcctccagaatttttaggactttttctaattggtgtaatcgggcatcggtagtccctggttcaatcagtgcgcaacgaattgtatcgtggattagcgtcatttccgcccactgtatctcagcatgcggttcaagtggtgcaactaatctggtcacataaacttcgttgtagtgatagtgcatttgaaatagctcgtaatacttactattctgagtattcttaataaattggcgagcttcatcgaccaaattttcgccacgcctttcattttgccgaattgcctggtggatatcctgaattgcgatttgatataaataacggtaagcatctggtacatctttaaagtaattataaaatgcaccacgtgaaattccggcacccttcacgatgcgagcaacttgtgcttctgtaaccggatgatgcgtgaattccaataatagcgattcttcgatggccgttcttttatccggtttcaacttctttaaaacatctgaagccactcctccacctccttaaaataaaaatgacaccgtgtcaacaatgctagaatagcacacagtgacaccgtgtcaaaattatttgcttatttttttaagttaacggtctgcgtggcaattttctggacaaactcccgatcatgttccaccactaataaggtgggcttgaacttcaaaactaaattttgaatttgttcccgtgtaattacatctaggtagtttaggggttcatcccaaatatatagattggcttcttcacacagcgaccgagctaaggcaacttttctcttctgtcccatactcatctgctcaattcgataatcaaacatcgtacgttcaaaacccagttttctcagcattgccagcaagccctgaacttcaacttccttttcggcagcaaactgttctagtgtgccttggagctggtcaaaatcctgtggtaaatatgatattcgtaaattttcgcgtatttttagattacctttagcaattagttcgttttgccctaacattgccttaattaaggttgattttccagaaccattttcgccttgaataaccatccgctcattcttctttagttcaagattaagcggctgatttaatagttttccagctcgttgtaaaactaaactatccgcttctagtaaagcattgttttggggtccgagatacggttgataattcaattgaagttcatcctgaatttcaatattctttagtaattgtttcttatctgttaattttttctcagcccgatcccgaatattcaaggctttgctcatcactttagctgctttatgacctacaaaacccttatccggagcaccagcttttttacgttctgttgctcgggaccactcttgcttttggcgcgtggcctgttctaatttttttatatcttttttcatcgtggcattcaaactgatttcacgttcatccgcattggcacgttcaactgcccaagtttcataattccccttaaagctgctaatttgagcacgatcaattgaaataacatgatcaataacttgatttaaaaagtaacgatcatgactaaccacaatgtatccttgtttttgttttaaatatttagctaaaaggtcgcgcccagctgcatccaaatgattcgtcggttcgtcaatcaattgaaatgaattttgatctgcaaacatggctgctaaaagggctttggtttgttgccccggacttagtgatgcataagtctgttctaaaatttcttcagcaagtccaatctggtctagttcacgctcaatctcccagaaatcagagtaatcgcgatcagtaattttcatcaggaccattcgcaccgaatcctgtggttcagtaattttagctggaaaataattgaacttcaggttggtttccactttcccctcatattcaacctgattctgcaaaatcttcatcagcgtcgttttaccacgcccatttctgccaatcagacctaatttccagctcgcatcgatttccaacgctacttggtcaaaaaacggttttatttggttatcgtagctaaagcttacgttttttaattgtattattcccatttatgtctcctctctttcgaggagtagttcgttttaaggcataaaaaagcaccaggtgtgcaggcctgatgcaatacaaagtgcataataccaataaaaatttatttttggtcggcacatcgaatgtatcaaaaactacaaactactcccgaaaataaagaaatcgtcattccaatatttccaaaattagtctgcaatcttcaatcccatcgacatcccttcctaataaactagccttagcttaacaatgaatgcgttttttttcaagaaatatccctctttgtaatctgatattaaaataagacccaagttagtgtaacgcttatttatttagtcattaataatattccaaaaatgattagcgccccatacacaagtttaatggctctttcgggagcaattcgcgctactagccaattaccaaaaggtaccactactagcaagcctggaataaccatagctaatacttccaacgcatctatcgaccaaaaacccgctgctagatggcttgcaacgaccaagattcccacacataaaaagtgagcttggagaatggcccgtaactgttgggctgaccattttttcaaagttccatatacggccactggcacaccatggctgttgtatgcactacctagcacgcctgaaataattccggtcaaataatcatagccttgtgcttgtaaatgggggcgcccgactcggcctgaaagactatgccacaagctataaatcccgtaagcaattaaaaaaattcctaagccatgtaacacaattgcggcaggaactttcttaatgactaaaattcctagaggtactccaattagtgaacctgtcactaatcgacgaaccgctttaaaatcaatatgatgccactcacgaatcgtggctggtaaagcaaccagtaagcccaccgctccgattaatgcggtgctggtctgtagatcaaacccaattaatgccaataatggcatcgaaactagagcttccccaaatccgaaaactgtacgtgtcagtgctccaacccatgctattagcaatacccctaaaataatcatttcaattcctcatttcagtcattacaagacttaattgtatatggaaaaagcaaaatcgacaacggtgtaaactaatttctagacgtcgataaaattaagatttccattacccaattggtgttctttgaccattccaccttaaaattgaagttcattttttgcttcaagctccattgctgaacttcaatttaatcaaaaaagatgcggatgcgttataatggtggacacaaggagttgaatattttgcatatattaacagttatcttagttgcactcgtagccattgagcatattggcatcatgggcattgaattattgggttctagtgcatttcttgccaaaacctttgaaattcccttagtggaagttcaacgccctcatttacgaacggcgttagccaatcaaggtctttataacggcttcgtggccttagccctcttcttggcactctttattccaacagggactattatgaagatgatgctcatctttttcctagcaagcatttttatcttagcagcatacggtgctctcaccgtcgccaaaaagattcttttagtccaaggtttacctgccttgattactttgattttggtattatttattttctaaataaaaaaggatagccttagaggctatccttttttattagattcgtataaaattgctttccgtttaatgccttcaataatgaacgcgataactactaaaacaattaaaattgtaaatagtcctaaactataaaggaaaacaaatgaggttgattcaattatcatactaccaactaaggggccgattgcccggccagccgaaggaaaagcacttgctagaccttgatattttcccttttggtcataaggtgaaagactgttaacgattgctggaatcgatggaaaggcaattgcttctccaatggttaaaacaatcatggcgattacaaagtggtaatattcgtgtgctacggctagaattccaaaagatagggtaaaaaatgcaatccccaaatagacttgatgatatggatccttcagtaaacgtccccctttggagctgagaagcccttgaacgattaaaatgaataatccattgaccgtccataaaaagctgtataaacgaagcggaatgtgcaattttagcatatagatcgaaaccgtactattccattgttgatagaaaacccacataattaccaaactaatgaaaaatgccatgataattgtcaagttaacttttggcattttagttttctcatgatcgtcttcttgtactacttgagcagggcgatcttcttgtggaattcggtaagtaaagaacgctacaatgaaaaataccgtaaacataatggttgctatggtgaaaagcggcgtgacactgtgcttaaataaaactcccacaatagcagtgcctagcatgacccctaaattttggacgaaatatagcatgttaaaaacatatcggccatctttactcttaattgatgttcccattgagttatttaaggcaacaatccaacctgttccaaatccgattagtaccaatacaatcggatatactggccagccgttgaagaaaatcaacgtaaagaacgaaatccaggtaaatgcaactccacctaagattaaataatagctatcatacttgtcataaaggcgcccggcaacaaaagatcctaaaatactagcaactgagtttaaaaataaaacaatccctgccattactaatgaatggcctagttcttggttcatataaattgttgttagtggccacactgaactcatcgcaatactatcaatcaaaactcctaataataaccactttaattttaattcgcgcataattcctcccctaatttttataataaaagactgatttagactaaaaagtcttaaaccagtcttgaaaataatgaatctcatttttcaaatacctaatgcgctcccgcttcaggcatataagctaacgaagaaaatttattgtacgacttaataaacaacagatttaccgtaccacgagccccactacggtttttttcaatgataacttcaacgggaccaacattttgatcttcttcatcccgtggatcctggtctcgatctgcgtcttcattgccatcttcccgttcataataatcatcacggtataggaacgctacaatatccgcatcctgttcaattgaaccagattcacggatatcagacattaccgggcgcttatcttgacgttgttccactccacgtgaaagctgtgaaagcgcaatgaccggtacgcctagttccttggcgagttttttaagttgtcgtgaaatagctgaaacttcttgctgacgattttctccagatccttcaattagctgcaagtaatctaccacaactaagccaaggtttccttgctctttagctagacgacgacattttgcacgaatctccgacattttaattcccggattatcatcgatatagatacttgccttagctaaagaacccatcgccaccactaaattttgccattcttcttcatttagctgaccggttcttaaatgatttgcatcaatacttccttccgcacataacatacgatttaccagctgttcagctcccatttccaaactgaaaatagccactgatttatcagtcttagtacccacattttgcgcaatatttaacgcaaacgcagtcttaccgacagctggacgcgctgcaagaataattaattcatctgcatgtaatccagtagtaattttatctaactctttaaatccggttggtaatccggtaatctcatcgtcattttgataaagacgatcaatttcttccattgaagttgttaaaacatctgcaattggcttaaaacccgtttgattacggttttcagcaacatccatgatttcacgttcagcttcgtccaagatattagccacatcgtcatcttgggtgtaaccttttgtagcaatcgctgttgctgtcttaattaattttcgtaataaagatttttcttgaacaatcttagcgtagtagccgacattggctgcggttggaactgatcctgccaattcagcaatgtaagtaattccaccggcatcttcgatttgattatgttcttcaagtgcattgttgactgtcaatgcgtcaatggcttcatccgcatcgttcaaatcaaccatcactttaaaaataacttgatgagcgtgtttataaaaatcttccgccgtgacgtattccatcgcgtcaatcaatgcatctgaacttaagaaaacagctcccaaaaccgccttttcggcctcaatgttttgcggaggcgtttgattttctaaaataccgttgtccatgttactctcccgtacgaattagactctgagttgagagccttagtaatcctattgctcagctacatgcacccgaatcgttgctgttaccttttggtgtaacttaacgggaacgtttgtgtagcccatgctacggatggggttgctcaactcaattttgcgtttatcaattttaatcttatattgtttttcaagggccgtagcgatttgtttgttcggaattgaaccaaatagacggccatcttttccagccttggctttgatttcaaccacggtcttatcatcttctaaaaccgttttaagcttttcagcatcagccaaaatttcagcttcatgcttagcttcggcctttttttgaccctttaattcgcttaccgcagcgcttgtagcagctttagctttaccatttttaattaagaaattttgggcgtaaccatcggaaacgttcttaacttcgccacgtttccccttacctttgacatcttccaaaaaaattactttcatcagaatcactcctcatctttttgattttcttgtaaaatttcaaccaattgttgctcggcttcctcaacactcacatcttctatctgagttgctgccattgctaaatgaccgcctccaccaagttcttccataataacctggacgttttccgttcctgcacttcgcgccgaaattcccacagcatggtctccacgacgtgtgatcacaaatgaggcttctacgcccgaaatattcagtagtgaatcggctgcctgagccgcaatcactggatcatacattcgatcatcttcaccggtacaaattgcatatttatcttcaataaactgcattgtatcaattaaatggtttcgttgcatataactatcaacattctcttttaagaggtaacgaatcgtcttctcgttagctcccactgaacgaagataactggctgcatcaaaagttcttgtccccgtacgttccgtgaacgatttagtatccacttcaatccctgccaaaatagcagtggcctcaatcggttgaattggttcaccatcatgggactgatattcaaacatttccgtaatcaactcacccgtcgatgatgcatatggttcaatgtaaaccaacacgggattttctggaaactccgttccacggcgatgatgatcaatgataatcacccgattactaagcttatcaaatagctcctcagatgtcgttatggaacgtttagaatgatcaaccatcactaacaaactttggctattagcgagctctacggcttgatctgcactaataatggactctttaaggtcttcatgctcatccattttttcaatcaaacgcgctacatccgaatgcacgccttcttggtctaagacaatccaacactcttttttattcatttgcgcaattcgccgaatcccgagcgctgaacccactgaatctaagtccgcatgggagtgccccattacaaagacttgatctgcttggttcattaattcttgaacggcttgtccaatcatccgcgctcgaacgcgagtccgtttttccatcggattagttttaccgccgtagaaacgagcttgttcatcttcagctttgacgacaacttggtcaccaccacgtcctagcgctaaatccagattactttgcgaaacatcggcaagcttattaagattatcatccccgtaagcaatcccgatacttaatgtaactggagagttttgtttagaagttgcttctcggatagtatccaagagcttaaaactatccttttccaccttagctaacgtttcattgtacatgatgacaaagaaatgatcatcatcaacgcgccttaaatacatcccaaacgattgcgcccaactagaaatctggttggtaacaaagttgtttaaattagaaacttccgaatcagccatcgactgtgtaatttcatcatagttatcaataaaaatttgaccaattaccacttgacggtcatcgaattgctcttccattttcgcgtatttagtcgaatctaggaagtaaactacgcgatcatccttttgaattgaaatatcaaaaacgtgatcgttccatttcacacggctaactttctcgtcatcttgatgttcttcaataatcttcgccaaatcttcatcgatttcatccaatggatgtcccaaaagtttttgtccttcaaaataactttggaaattagggttaacccattccactcgatgctgttcactataaattaaaattccaattggcatagacaacgtagcgtcttcttcagcctgatcaattcgaaacgacaattcagaaatatatttatcagtctcatcactcagtaaacgcaacgtgcgaacactaaaaatgccagtaacaataaccaatactagcatgatgatgccgattaataagttaatataaaaagctaatcccagcccaatcaacgacagcaaaataataactgctgttaaaatcccgacccgcgggttacggataaatgcaggtagatgatctactaatttcatagcacttctcctaaaaaattgtgtctaactatctctgattttaccatacttataaccaataattaaaatcgtttgttggaaggttattctaataaaaatagagccataattgaccaactatgatccatcaccgccctaattttatttaaacaaaaagtaccattcaagcctcggcctgaatggtactttatatagctaaagattagtcttcagcaacgaatggaagcaagcccatgatccgtgcacgcttgattgcaatagtcaaacgacgttggttcttagcacttgtaccactgacacgacgaggtaagatcttaccacgttctgaaatgaatcgttttaacaattctgtgtctttgtaatcgatgtattcaatatggtttgcagcaatgtagtcgactttacgacgacgacggccaccacgtttttgaaatgccataatgattgccctcctctattattttagaatggtaaatcatcgtcagaaatatcaattgactgaccgccattagcaaatgggtcattagggttcgaattgttaggttgttgtgcaccactattattcgattgtcctccgtcaaatggatttccggatgatgttggttgttgtgaaggggcagattgattattgccaaaattattttctccaccctgacgacgttcagaagatgaacgtgattcaagaagagagaagttttcggctacaacctcggtaacataaactcgttggccttgttggttttcataagaacgggtttgaatccgtccgtcgataccaactaatgaacccttccgagtgaagttagcaaagttttctgcagctttacgccacataacacaattaataaagtcagcttcgcgttcaccttgtgaattagtaaactgacgattaacagcaactgtaaaagttactactgcagctccactacctgtatatcgtagttcagggtcccttgttaggcgtccgacaagcactgttcggttaatcataatatccgctccttcctagtttttagttgttattattaacgtacaacgatcatgtgacgaagaattccgtcagcaatcttagatagacgatcaaattcgttcaaagcttcgtcgtcgctagccttaacgttaacgatatgataaataccgtcgttaaaaccaccgatttcgtatgctagacggcgttttgaccagtcttttgaatcaacaatttcagcaccattgtctgtcaaaatcttgtcaaaacggtcaactaaagctgtcttagctgcatcgtcaagatttggagcgatgatgtatgtgatttcgtagtttttcattgatttacacctcctcatggacttatggccttctatcacaacgtagaaagcaaggagagtttgccaaaaaagctggcaactcacaaataagtattataccatccatttttagtggacgcaataacaaaaaatcctaattaacgatatacaaatgataaatacaccaaaattttctaattcattttattaattaaaaaagctgattaaaaagtgaaaaatcacttcaatcagctttttaattaaatctattcttcagaactttcttcaacagttacactttcagtttctgctgcttcagttgctggagtttgagtctggttttcatcatcaactggtgcttcatcaacaattgccattgtagcaactttagaattttcatccgtcttgattacgtgaacccctaaggtcgcccgacctgtagttgaaacattattaacgtcgaaacgaatcataaccccacgatccgtaatcaacataacgtcttccgttccttccaccgttactaatccagctaatggaccattcttttcggtgatattcgcagtcttaatccctttaccgccgcggcctttaattgggtattcactagccggagtttgttttccataacccttttcagtaataaccaagaccttgctttcaggtttcaagattgctgaaccgacgacataatcttcatctcgtaaacgaattccgcgaaccccagtagcagaacgtcccattgaacgcacatctgcttctttaaagcttaccgcgtatccgttatgcgttccgataataatgttttgctcgccatcggtaataaccacgttaattacttcatcattttccttcaagctaatggccttaagcccattgctgcggatatttaggaattcagcaaccggtgttcgttttgtcacaccgtttaacgttgtaaaaaagaggtaacgattttcattatcttcatcaccgttatcacgtccaatattgattacagcctgaatattttctccgctactaattccaagcaagttaattactggaattcccttagcggttcggctatattcagggatttcgtaacctttcatccggtaaaccttaccggcattggtgaagaataagagtacatcatgggttgaagttgaaaccagatgttcgataaagtcgtcatcatgaacacccatcccttggattcctcgaccaccgcgattttgcgtcttaaattcagacgtagccattcgcttaatgtagccattatgggttaaagtaaccatgacatcttcttcttcgattaagtcttcatcttcaaggctaagaacttcaccgaccatcaattctgtccgacgttcatccccaaagcgctcttgaatttcaagtaactctttataaatgatttcgttaattcgttcacggtgagctaaaatatcacggtaatccgtaattgctgccatgaccttgttgtactcgtcttcaaccttttcacgttctagtcctgtcaaacgcaccaagcgcatatccaagattgcttgagcttgcttacttgataatgaatagttattcatcaatttatctttagcaacctcagccgtttgtgaattacgaataatcgcaataatttcatcgatgtggtccaaagcaatccgcaaaccttctaagatgtgcgcccttgcttcagccttcttcaaatcaaattcagtccgtcgacgaataacttcttcttgatgaacaagatagtgttgcaaaatttcctttaggcctaatactttaggagcaccattaacgatggccaacatattaaatccaaaggtcgtttgcattaatgtcatcttgtaaagattattcaaaactatagatgcactaacatcacgacgaacatcaatgacaactcgaagtccatcacgatcggattcatcatttacatcagtaatcccttcaattcgtttatcacgagctaattcagcaatgcgttcgatcaatttagccttattgaccatgtatggtaattctgtagccacaatgcgttcgcgaccatttttttcagtctcaatatcaactttcgcccgtaaaataatcgtaccgtgtccagtctcatatgccttacggattcccgatttacccatcacaattccaccggttgggaagtctggcccagggacagcttccatcaagtcggcggttgttgcatcttcgttattcatcaaaatatggatagcgctgatgacttctgacaaattatgtggtggaatattcgtcgtcatccccacggcaatcccagttgctccgttaactaataagtttgggaaacgtgctggtaaaattgatggttcgcgttccgttccatcatagttttcttggaaatccacggtatttttattgatatcacgtagcatttccaatgtaattttactcattcgagcttcggtataacgcatagcagcagcgccatccccatcgacagatccaaagttaccatgtccatcaacaagcatgtaacggtaactaaagtcttgggccatccggaccattgattcataaattgcagagtcaccatgaggatgatacttacccataacatccccaacgattctggctgacttcttatatggcttttcaggtgtaactcctaactcattcatcccgtataaaatacgacgatggacgggttttagtccatcccgaacgtcaggtaaagcacgcgcaacaataacactcatggcataatccaagaatgatgtacgcatttgactacttaaattgacatctgtaattcgtcctgacaattcttctgacaattcgttttcccccttattttttgggctgtctaacttttaataatctttttagatatccaagtttttaacaaacacagcgttctcttcaatgaatttacgacgtggttcaaccttgtcacccatcaacatttcaaaatcaccacttgcagcatcagcatcttcggctgaaactcgtaacaagcgtcgattttctggattcatggttgtttcccaaagttgctcagcatccatttcaccaagacctttataacgttgaattacaggttttggtgatggtgataactgtccaagtactgtttctaattcttcatcagaatcgatatattggatcatcttaccttgacgtacttggtagagtggtggttgagcaatgtaaacaaatcctgcatcaatcattggacgcatgtaacgatagaacagcgtcaataatagtgtccgaatatgagcgccatcgacatcggcatcggtcatgataatcaatttatgatagttggctttgcttacatcaaaatcctcaccaaatccagttccgagcgctgtaaagagtgaacgaatttcttcattggccaaaactcgatccaaagtggctttttcaacgttcaaaatcttcccacgaattggcaaaatagcttgtgtgagacgcgaacgtccggacttagcactaccaccagcagaatcaccctcgacaatgaataattcactaattgaaggatccttagaagtattatcagctaatttaccaggaagattattgagttctaggccactcttcttacgcgtaacttcacgagctcgtttagcggcgacccgtgcttttgctgccaagattcccttatcaacaatttgacgtgcaaccttaggattttccaataagaatttattgaaagtttcagcaaacacttcgttaacagctgtccgtgcatctgagttacccagttttgttttcgtttgtccttcgaattgaggatcaggatgcttaacgctgactactgccgtcaaaccttctcgaacatcatcaccagacaatttatcatcattttcttttaaaatattgttgtttttagcgtaatcgttaataactcgtgttaaagcacgtttgaaaccttcttcgtgggtaccgccttcgtaagtatgaatattgttagtgaaagttagcaatttactttgatagccttcgatatattgcatagctacttcaacggtgatgccttttgtaaccccttcaacatagataggttcagggaaaattacttctttgccttcgtttaagtattcaacgtagtggcgaatcccaccttcgtacaagaagtcgtcttcagttggcttttcaggacgcatatccttcaaagtaatccgtagacccttgttcaaaaaggctaattcacgaattcgtgtttttaagatattaatgtcatatgtggtagtttcttggaaaatatctggatctggaacgaaatgaacaatagttccatgatcgtcaggatgttcagtatcaccaatcgttttcatcggtgtttttacttttcctagcgcaaaatcaatgtagtagattttaccgtccttcatgacgcgcgcatctaattccgttgataacgcatttacaacggatgcacccacaccatgcaatcctccggaaactttataaccgccaccgccgaatttacctccggcatgtaggaccgtaaagactgtttctaaagctggttttccagttttcttttggatatcaaccggaatcccacgtccattatcagtgacggtaatgctattgtctttttcaacgatcacatcaattttgtctgcaaatcctgcaagagcttcatcaataccattatcaataatttcccaaaccaaatggtgtagtccttgagaactagtcgacccaatatacatccctgggcgtttacgaactgcttcgagcccctctaaaacctgaatttgactcgcatcatattctctggctaattctgctttcgtttctttttcgtctgccaaaagcttattcctccttgctctgcattaaaactccgtgatcaatattaaagacatggggttcattaattaattgttgcgcaacaccactaaggctggtggttgtgatgaaagtttgtactttgttttgaatggcagttaacaggtgtgtttgacgactatcgtcaagttcagataacacatcatcaagtaaaagaaccggatattctccggtttcttctttcatcaaatcaatttctgctaatttaacactcagggccgtggttcgttgttgcccctgtgaaccaaacgtcgatacgttcttgtcattaaccataaatcgcacatcgtcaagatgtggccctactaaagttttaccttgttgaagctccttttcacgttgcttttggaaaagagcttgtaatgctgcatagattttttcagtagtatcggcttgatcactactgatcggtgaaacatattgaaaggataatttttcttttccctgcgagatttccttatgcacctcttgggaccatttttccaacttcttcaagaattgaatgcgttggaaaatgatttcagctccatgggctgctagctgatcacttaaaacatctaaataaacttggtcacccttaggattgaactgtagctgtttaatgtactggtttcgctgtttcagaacggatcgatattgcgccgagttatatagatatttcgaactcatctgtccaaattccatatcaatgaacttacggcgaactgctggagatccttttacaattgataaatcctcgggcgcaaacaaaatcacattaagctggccgacatattgcgataaacggctttgctcaaggtgatttactttggcatttttccctttggaagataaattgatttcaagcggtgtaacggtgtgttctttttggacactccctgatactcgcgctgctttggttttccaactaatcaaatctcgatcactattggttcggtgacttctagtcaaagctaagaaataaatagattctaatagattagtcttgccttgtgcattttcacccaatagaacattgattcccgaaccgaactcgacaacaagatcagcataattacgaaaattatgtaactccagtgtcttcagatacattagttaccagatttcattataatcttgaaagaaccttcatctggaacttcaactacatcatcttcgtaaagttttttcccacgacgatcatcgtgttctccgttaactaggacggtattttcacgtaaaaaccacttagcttgtccaccagtgccaataataccctcttctttcaagagttgtcctaaagtaataaactctgtgtttatttcaacatctttttgcatactatcaccccacgtatctcataatattatacctttattttaactaaaaaacaattttatctgtcttaaaacggcttctcagcgaatttaacccttctgaatgttttttgccttaaacgggttattttttctcaaatttacgtatacgcgtttttaaccagatttatccaaaaaaagagtttgagaaattaattttctcaaactccatagcgttactttattaaaatgttcgaacaggtgtgattaattgaataaagttttcttgatcttcagttggtaccaaagtaaatggacgtaatgctgaagtaaaggccatcttaattgatgtatgtccaaatgaacgtagcgcatctttcaaatagtctgggttaaaggaaatttcaaggtcttcacccacaatatctttagtaaccacttcttcttctacattaccgacttcaggagaatcaccagagatgattgcttgcttgttagccgcgttaatcgttaatttaaccacgttattgcgtccagcatgtgaaagcaatgaagcccgttcaatcgaagctaacaattctggagcttcaaattccatttcagttgaactttcctttggaattaaacgggatgtatctggatacaaaccctccaatagacgtgaatagaataaagtttcatcaaatgtaaataatgcttggttttctgaaatttgaagtgtaattgtatcaatttcatcatctaacattctggaaagttctaaaagactcttcccagggatgataatatcttcaggcattttaattggttctgggagattaattacccgttggctcaaacgatgactatccgttgctacggctgataatttatttccttcaatcgtaaaatgaatcccagttaagattggacgactttcttgattagaaactgcgataactgtttcattaatcatttcgctaaatacatcagcttttaaagtaatggttgtttgactatcaacttctggtaaatgagggaagttattagcatctaaaccattaattttaaattcagaagcacctgacgtaatggtcgtttgaaaaccgtcttttacctcaagtaacatagtgttgtctggtaattttttaacaatatctccgaagaaacgggctgttaaaactaccgctccggtactttcgatattaagatgagcttcttcatcgttagttgaaatggtggtttcgatagaaatgtcagtattgcttccagttagaattaaacgatcttcttctgcttcgatttttaatccagtcaaaattggaatcgtagttttagaagaaatggctctttgaaccgcatttaattttttgataaatgtatttcgagcgatggtaaatttcattttacaaaactcctttatgttgctctctgttttatatattaattaataataaaaagatagtagtagtaataagggctgttggaactgttaataactcaaattagccgtcataatttaacttttagcctgtggactacctgtggataactttcgaagttattaacacttatccacaatttaaggttttagctcactttttaaatctccaacttggcgagcaagttcctcatctttttctagttcagccttgatcttatcaaaggaatgaataacggtagtatggtctttaccaccaaattctgttccaattttaggcaatgaactttcagttaattcacgggatagatacatcgcaatctggcgtggaataacgatggatttcatccgtttctttcctttaaggtcagctactgtaacatggaaatattttgcgaccttgtcttgaatcattggaatcgtaatatggctaaggttgctaccgaaattcaaactgcgaagagcatctgaagctaaatcggtggtaatcgctgcgttttgcaatttagcgtaagcctggattcgagccattgccccctctaactcacgaatatttgaatcaatacgattagcgatgtattccaaggtttcgtcaggaatttcaacgttatctgcttgagccttctcccgcaagattgcaattcgagtttctaaattagggggcgtgatatcaattgaaagtccccacttaaatcttgataccaaacgttcttgcaacttcggaatttcatttggtaagcgatcggatgtcaacacgatttgtttttgggcattatacaaggcctcaaatgtatggaaaaattcctcttgagttgcttctttatccgcaaaaaactgcacatcatctactaataaaagatcaacgttacgatacttctcatgaaactcttccgtcttattcttttgaatcgaattaatgaagtcgttagtgaaggcttcacttgttacatatttaacgcgagttttgggatcattttctaataactgatgcccaatcgcatgcattaaatgggtttttccaagtcccactcctccatagaaaaagagcggattatatagaacgccaggttcatctgatacagccatcgcagctgcatgcgccatttggttaccactaccaataacaaaagtatcaaaagtatatctactattaagttgggtatcttcagtagaagctttggtttcttttttagaggtagcggacccttccgcctgctgtgtcttgaattcatcttccgttacgaattcaggtgtaatgtcttgatcagtgaactggtaggcatattcgacaaacttctcgatcaaatgctttgtccagtaatctcgatgtagactcgaaagaaccttaatcttcattatgtggttttctaatgaaatgggttctgccgtttctacccaagcaccgaaactggcctttgacatggagtcgtctttttcgaaactatttttaatgttgttccaaaggtcaatatagttaggcactttttcaattcctccaaaatttttagctcactaagtttaacataaaaaaataaagttatccacatggatgtggataactaaatggggttaaataacagtctgtgatctaagttatccacagggtgttatcaagcaattctcttttcgtagaaatttaagttataaacagaaacctgtggataactattattgttatatcaacgtttatttaacatatccacagatttccacaaggctgtggataactatataaacaccctgtgagcgaaaaaaatcgctgcgaaaaagcctgttgataagtcgaaatcacttaaaaagttatccacaaagtatagacaagctaacgctctgtttgtggataaaattttggattttattttaaattatttcctaataggtggtttgatttattctgtaggtatgatattatgttaaggtaattgtttaaacgacataaactgatttatcgaaaattaaaaaatagatataaaaattcagtatgtgtattttcgttcaggaggtggaccataatgaaacgaacatatcaacctaagaaacgccatcgtcaacgcgttcacggtttccgcaagcgcatgagcacaagcaacggccgtaaagttttagcacgtagacgtcaaaaaggtagaaaagtattatctgcataataaggccactgatcccagtggtcttttattttttaaatttttagagacaatagaagcttttttacatataatgtttgttagtgatatatatataggttgtggagagaaataatgcgaaagtcgtatcgaatcaaaaaagaacttgagtttcaaaaggtctttgaaactcgtaattcatttgcaaataaaaaatttgtcgtttacgtgatggacaaaccagaacaacctcactttagggttggaatttccgttgggaaaaaaatcggtaatgcggtaatgcgtaattatacaaaacgtcgaattcgtcaaagcattttggaattcaagcctcttttacgtcaagacgtcgattttttagttatagcacgtccacaagcttctggactaccaatgaatgaagttaaacaacaattggaacatgtttttaagctagcagggttgtttgcttcaaaacaaagtgaggaagaatagtgaaacatttaaaacgaaatatggcgttgctcagtgtggcagccctatccttcatattaactgcgtgtagcacagcgcccatcaccagtcacagtactgggatttgggacggagtgattgtttacaatttctcgagattcatcatctacttatccaagttgtttggtggcaattatggttggggtattattgttttcaccataataattcgaattatcatcttaccattgatgatttatcaaactagaacaacgatgaaaacagctgaacttcaacccaagttaaaacagttacagcaaaaatattcatcacgagatgctgaaagtcagcaaaaacttcgtgaagaacagcaaaagctttatgctgaagctggggtaaatccgatggctggatgtttgccattgatcatccaattaccagttatgtatgctttgtatgcggcggttagccggacccaagtgttaaaagagggtactttcttatggctacaattgagtgataaagatccttactttattttgcccatcttagccgccttgttcacatttatgagtacttggttgtcgatgaagtcacaacccgctggatcacaaaatggaatgacatcggccatgacgtttggtatgccactagtaattttgattactgctttaaacttcccagcagcgatcacattatactgggtagtaactaacctattccaagttggtcaaacacttataattcagaatccgttcaagatccaaaaagaacgtgaagaaaaaattcaaactgaaaaggcaaagcgtaaagcaattgaaaaagctaaacgccgagcaatgaagagtaaacgaaaataatttatgaaagcaatcgcaactgtttcgcaggggggattgcttttttaatggactaaatgcaggttgatttaagtaacgtgatgatggagtgatatgatgcccatagagctggattagattaatgagaataaaaaattgacaaatccgtctttaaattttatgatgtagttcgtataaagtgaatatgatgaagtagtgaaagtgctttgtccaccctatatccaagtggctaactggattatgggtggaactgcgctttttttattggaaaaagaaaggataacattatgcaaactgtttcaactgaatttgacacaattgcagcaatttcaactccacctggggaaggcggaatttcaattattcgaattagcggggtggatgcacttaaaactgccagccagatttatcgtggcaaagatttgaataaggtgaatagccataccattaattatggtcatattattgatccagaaaatggaaatgaagtagatgaagtaatggtgtctgtaatgcgtgcgccacatacgtacaccaaggaagatatcgtcgaaattaattgtcatggtgggattgtcgcaactaaccgaattttacagattattttagggttagatgcgagattggctaaaccgggtgaatttactgaacgagcttttttgaatggacgaatcgatttgtctcaagcagaagccgtaatggatttaattcgtgctaaaactgatcaatcgatgaaagtggcgcttgatcagttagatggaaatttatcccatttaattactaatttacgtcaaaatatcttagatgttttagcacaagttgaagttaacattgattatccagaatatgacgatgttgaaacaatgacagctcggttacttaaagaaaaagcaattgaagttaaagcgaagattcaacaattactttcaactgctaaacaaggtaaagtgctccgtgatgggctggctaccgccattattgggcatcccaatgtcggtaaatctagtattctaaatcatcttttacatgaagataaggccatcgtcacggatgttgctggtacaactcgtgatgtaattgaagaatatgttaacgttcaaggagtcccacttaagttggttgacacagctggtatccatgaaacagaagataaagttgaaaaaattggagtggatcgaagccgcaaagctctttcacaagccgatttagttatcttggttttagatagtagtgttccactgcgcgatgaggatcgagagctgctgagagaaaccaatcatatgcagcggatcgtcgtgctcaataaatcagatttagaagtaaaaattaacttaaatgaacttcaagaatatgtagatgataaagaaattatcaaatcatcagccgtttcacctttaggaaccaaagacctcgaggaccgtattgcagcaatgttttttgctggaagtattgaaaatacctctaataatattatggtaactaacgctcgtcatattggattgttgaagcaagctgaaacagctttagatgccgttcttgaagggattgaaacaggaatgccagttgatttagttcaaattgatatgacacgtgcttgggatttattgggtgaaattactggtgatagttaccaggacgaattattagatcagttatttagtcaattttgtttaggaaaataaatttggagttgaaaaatatgtctgaagtaaaacaatatgaagatcgcgagtatgacgtaattgtagtaggagctggacatgctggctcggaagcggcgctcgctgccgctcgaatgggtaataaaaccctcttaatgaccattaatctcgacatggtggcatttatgccatgtaacccttccattggtggtccagccaaaggaattgttgtccgagaaattgatgcattaggcggcgaaatgggtcgcaatattgataaaacttatgttcaaatgcggatgttaaataccggaaaaggcccagcggtgcgcgcgctgcgcgcgcaggctgataagcatgcttatcatgctgagatgaaaaagaccatcgaagctgaacctaatttgactttgcgtcaaggaattgtagatgacttaattgttgaagatggggtctgcaagggagttattattaacaccggcgcccgttatcaagctaaaagtgttgttctaacattagggacagctgctcgcggtaaaattatcattggtgaacttcaatattcatccggtcctaacaattctcaagctgcgctagagttaaccaaaaacttgaccgaaaaatatcactttgacttagagcgcttcaagacggggacacctcctcgagttgatggcggaactatcaactacgatgaaaccgaagaacaacctggtgatgaagttcctaatcattttagtttccaaacaccagatagtaagtacattgaacttaaaaatcaattatcttgctggttgacttacacaaatgaaaaaacgcatgaaatcattcgtgagaatttagatcgagctcccatgttttcaggaatgattgaaggtgtcggacctcgttactgcccttcaatcgaagataagattgttcgttttgcggacaagagtcgtcaccagttgttccttgaaccagaaggccgtaaaactgacgaatggtatgtccaaggactttcaacttcaatgcctgaagaagtgcagcaacaaattttgcattccattaaggggctagaagaagctgaaatgatgcgtcccggatatgcgatcgaatacgatgtggtagcaccttatcaattgaagaacactttggaaactaaactagtaaagaatttatatactgctggtcaaactaacggaacatcaggatatgaagaagctgctggtcaaggtctaattgcagggattaatgctggccgtcgggccctaggtaaggagcctttaacgctgaaacgtagtgatgcttacatcggtgtaatgatcgatgatttggtaactaagggtactaaagagccttatcgtttgttgaccagtcgtgcagaatatcgtttaattttacgtcatgataatgctgatttacgcttaacagaagtgggacataacttaggtttggttagtgacgaagaatataatgcattccttgaaaagaaacaagatattaaggatgaactacaacgtttgtcagaaattcgaatcaaacctagtcaagttcaagaattcctagaatcaaagggttctaacggcttaaaagatggggttttagcatcagaatttctacggcgtccggaagttaactatagtgacttattgaagttcattgatgctccagaaaaagatttagatcgtcgagtaattgaacaggtcgaaatcgaaactaaatatgctggatatattaaaaaggctcaagatcgggtggatcgtttgaagcggatggaagaaaaggctatcccagatcggattgattatgaagctattaatggattggccactgaaggtcgccaaaagctcgaaaaaatccgtccaactaccattgcacaggcttcacggattagcggggtaacgccagctgacattgcaatcttgagtgtttatatccaacaaggaaaaatcgcaaaaatcgcagaataacaaaaattagccccttgaaaaattcaaggagcttttttgtttcacaaaaaagaatgtttcacgtgaaactgaaaaaattaatgttagttctgctaaaataggcagtaaaaaaggagaatggcatgaagataattattgcaccagctaagaagatgcaagtagatacagattcctttgacgcgacgacgatgccagtatatttgaggcaaacccagaagattctgacgatgatgaaacaactcacgtactcagatcttaaaacgttatggaagtgtagcgataaacttgctcaattgaattatgagcgtctgcaaggtttagatttaaaatatcagctaacgccatcaattatggcttacgtcggaattcaatatcaatatatggctccagacttaatgacggaaaagcagttggcttatatacaggaacatttaagaattctatctggattttacggagtgctacgtccatttgatgggattgtcccatatcgactagaaatgcaagcgaagttaaaaatagacaactataataacttataccaattttggggagctaagctttatcaaaatttatataaagataatcgagccgtcgttaatttagcgtctaaagaatatgaaaaagccgtgcgtccgtttcttcaagaagacgataaaatgactacttgtatttttggagaaattatcgatggaaagataaagcaaaaagcaactccggccaaagaagctcgaggagaaatggttaattttatggcgcttaaccaagttaaaaataccaaagaactgaagagctttgatcgtttaaactatgcttaccgagctgatttatcaagtgctgataaaatggtgtttatcaaaaatgaacttcacaaataatggtttaaacaaattttgaacttaaatttaaggtaggcaaacacccatagattggcaaatataacagttatattgcaaaagtatataaaaatatcaagttttcatttcaaaagtaaaatttctaagacaagtaactaagtttgggctacaataagattcattaagagactaaagtgtttggaggaagatcgatgcgttttttgagagattggattttaccaatcgtaattggattattagttgcactgctagttaaaacattcctgtttcaatttgttaaggtagatggctcttcaatgcaacctaacctacaagatagtgaacgagtattagtttggaaaccaatggaagttaagcggatgagtgtaattgtttttgatgctcatggagaagatccggcagctactgaacccgtagattatgttaagcgggtcatcggtgttcctggggacacaattagttataaagatggaaagttgtatgttaatgataagttagttcctcaaaaatttattgatgaagaacaacgcacaacggggactggaaactggaccttagcttcaattgccaacaaatatggctgggctaagagtcctaaaaaggtacccaaggattcgtactttgtgttaggagatcatcgaagtgtttctaacgatagtcgatactggggatttgttaagaagtctaaagtaatgggtgttgtgaaggttccattttggagtaaaaatgatcaagctaagaaaaatatcaataagttagcaaccgattaagctaagaaagctgtgagatagtcgcagctttttttgtttgtttttatgaaggtaagcgctaaaattaaattaacgtaccagctagtaaaagagattggtaacttggaacttaatcgtggaggaatgaaaaatgaagcgtgatccgaattgtgttttttgccagaaaacaaaggaagattatattgttgaaaataaattagcagcgtcatttttagatttttatccagttagtaagggacatactttaatcgtacctaaacggcatgtccgtcaattgtgggaattaaatgaagaggaaagacacgcaatttttacattggtcgaaaaaaataaggcgatcttagaccaaaaataccaaccggatggatataatgtggtagtaaattcaggtgcggcggcaggccagagtgtttttcactgtcatatccatctcataccacgctactggaatgaagatccaaagcgtaaaccggttccgggccaattcttagtacctccggagcgtcctcaattcaaggggatggattagaaaataaattaaaaagcattcggtactttataaagtatcgaatgctttattattttaagaaataaaaaaacgtctcaccaggggggagagacgcatatacaggtaataagtaactggtcgttagacctttcattcaccttatggggggagtaaatgaaaaagttatctatagtgccactataaaaagaaattgtgaagaaagtgtgaatttttgattgctgagaaattacagtttatcgggtttaatgtaatatttcaaaacgggtaaaatttagtcctaaaaaaaggctaaaataaaaaagttctttcatttttaaatctacatagtatcatgaatccatacgagtataatgggggatttagatgtttcaaattataaaagatattatatatattattcttattctaaatattattggtgccgtttatacagtttttagacaacgtcgagatatagctgctacttgggcctggttattggtcttatttttcttgcctggtgtaggctttgtgatatacgcctttgtgggacgaaagctaccagaaaacaaattatttccgctgaaaagtaagactcgccttcaattggatcaagttatggagcatcagcgtcgagagctaaaaaagaatgagtttactgctgctgatcaagttgttaaagattcagaacgaatggtccaattctttactaaaacggattattcttttttaaatcgaagaaatgaagttcaaatcatcacagatggaaatgaactttttgatgatatttttgctgaaattaaaaaagcgaaaaagcatattcacgttgaattttatacaatttatgatgatcaaattggcaatcagttacgcgagctattggaagaaaaagcacgtgaaggtgttgaagttaaggtgctatgggattcatggggatcgctaggtaccaaaagaagtttcttcaagaaattgaatgaactaggcggagaagcgtatccatttctaggtacacgttcagctttaactgactttcgattgaacttcagggatcaccgtaaaattgtcgtgattgatggtaagattggttatgttggtggttttaatgtgggagatcaatatttaggccgtaagaagaaatttggttattggcgagatacccatttgaaaatcatcggttctggagtttacggacttcaatcaagatttatcctggattggaatgctacagaccgtaaaaaacaaattgtcgaagagtttaaagctggatcagtttatttcccagtcgctgaagttaaaggcaataccagtcttcaaatcgttagtaatgggccagattcagatattgaaaaaattaaaatgggttatttgaaaatgattcataaagccagagaatcggtttggattcaatcaccatatttaattccagatgatagtgtcttggacgcattgcgcttagcagcaacatcgggagtagatgtccgagtaatgattccatgtatgcctgatcacgcgtttgtctatcgtgcaacccaatattatgcttggcagtgtgctaagtggggaattaaagtttactactacaacaatggtttcatccatgctaaaacgatggtagtggatggaaaaatatctacagtgggttctgcgaatatggatttccgtagtttcaaacttaattttgaagttaacgcctttatgtatgatgaaaatattgcaaaacaattgcaggaaatttatgaagaagatatcaaacattctagtctccaaaccgtagccatgtttaataaacaatccacatggctgaagttcaaacaaaccttttcacgtttgctttcaccaattttgtaagtaaaaagagttgacgttatttttaacccgtgataatcttgtaaaaaatcaattaaagcattttaactttcacattaagtagtgcataatctgggtgtcagaaagtcggtggttgctgcgaaccgatcagggttatgttgtcgaaataccgtggaatagtttaatttaacggaaaataactagaaccgttatcaatctagtgagtgaagaggtctttttgggttctcttaagctgggtggtaccacggtctccatatcgtccctgttgcatttatgatgcagcagggacatttttttggtcaaaataagggggacttggaatgaaaaaggttagtattttagaaactagcacggtattggttttaatgttagtgataatggggctaggagtaattaaattaaaattatctcctcaaacgccagtattgttagttttaggtttaataacgatgtgggctaagctacgaggttttgaatgggaagatatcaatcaaggaattaaaaatggaattgaaacggggattatccccatctttatttttattttagttggggcactaattagtgtctggattgcagccggtattattccgacgttaatggtaattggttttaagttgataaatgtagcatggtttgttccttcggtatttatcgtctgttcactagtcggtaccgctgtgggttcagcatttacggtaatgtcaacggtgggaatagcatttttcggtatgggagtcaccatgggagtcaatccggccctcgtggctggagcaattatttctggggcaatttttggtgataagtgttcgcccctttctgaatcaactaatttgtcggccgcagtagtagacgcagacctatttgatcatattaaaaatttaatgtggtcaacagttccagcatttgtaggagctttgattttatttacgataatggggatgggcgaagctaaaagtgcagacatgagtaagattaaccaaaccgtggctattttagaacagcacttcaacgtcaacttctgggttattattccaattgctttaatgtttatctgcgcttggatgagagtaccggccgttccaactctatttattaatatcggggtttctgtaatgtttgtttttatcggcaatcctcagattacagtaacaaaaattgcctcaattattgaaaatggatttatttcaaagactggtaatatagacgttgatcagctattaactcgaggtgggattgctagcatgatgggaaccgtagctttgattgttgtcaccttatctttgggtggtattttagtacacttaggcttaatcgaacaaatcatggcaccaatcgcgcaacgtttaaatagcgatgggaaactaatcttagcggtaattgctagtgcaattggggtgaatttattcatcggtgaacaattcctatctgtcatcttacctgggaaagcatttaaaccaacttttgaacgctcagggctagcaaacgtcacactaagccgtgcgcttgaagatggtggaacagtaattaattacattgtgccatggggggtagcgggtactttcgcggccaatacttttcatgtagcaactttaagttacctaccattcgtattctttagcttgttgtctccagtattctcaattttaagtggttttacaggaatcggaatcaaacatcgaaattaaaaaaacaggttacaagaggagaatattactccgattgtaacctgttttgaggttcagtaaaccaagcgactaaatggtcactaattgcttttgatccttctacgttaggatgaacttcatcatttgtttcaattacccaatctaaagttggaataagttcgatttttaaggctttagcgacgttcttgatgacgtgggaatgtgcctgattaaaaggtgtaattataataattctggcatgagggaatcgctttttaacttcatttataaaccaaacaaagtacatttcaaaaacatcatcctcatagcgagcatcattagtcccaagattaattaaaaccaaatcaggattaatccgaggagctttaacgctaaaattgacatattttacaaacttaccagctgggggaactcctcccgttccgtaacggattataccggcagcactataggcaatacgataatcttcccaatctaaagcgcgggataattgagcagcatagttaaggtcggctccataaccgatagaaggtgctttactacgaacccaacagccagcggtgatagaatcaccaataaaagcaacgagtgggccagccggtttaatagccgctagggtgcctgaggcaatcgtgatatctttaatggtaagtccgtcattacctaaccaaatctcatcttggtcagtattgcctgtaaaataaatccgaacaatatgagactgatttgaacttaatttaaaatcatttttagactgagtgagtggggttaaatgtaattcatcatcgatataaatgcttagagtttgaggagcagcaagaggcttaattaccacttctaaggtgaaataatcagcattttgaacttcaaacaaaatttgagcgcctaaattagtggtatacattgctggcttagtttcaacggtttgagttgtccaacgtcccataaaatagacgttaggaatgcacccattagccgaggtagggatgatttgattcatagtaagcctccgattttaagttaaccaggattatacatacattctatttcatgatcattaatcaagccgatagcttgcataaaggagtacgttgttacgggacccacaaacttaaaaccacgtttttttaagtcagccgaaatcatttcagagagcggggttttggcgtgaatttcctcaggaattcgaatatggtcgttaatctgacggttatttacaaatttccaaatatattcatcaaaactaccgaattcaagctgaatttcaataaaggccttagcattagaaatagtagccgctaatttacctcggtggtgtagaatttcgggagtttccattaactgatcaatatcagcttcagtcatggctgctaccacgtgaacttcaaagttatggaaaccttttttaaaggctgcacgcttattaataatcgtgttccaacttaaaccggcctgataaccctctaaacagagcatctcaaacatgtaacgatcgtcatgggagatttgtccccattctttagcatggtattcttgcatgagttcagaagcattttgagcccatgtacagataaaattattgttcattttgcattctccgattctaaataaaaatgcttttaactccctttgaaaaggtaattaaaaacattagtttaattaattcaattttagcacatcttacatatcccgatcgtagccattaaataacaaattaagaacgacagcagtgatactagcaatcacgatgccgttggtaagtagcattttaatagtagcgggaagggcttggtaaagttgaggataaatggttgagccaagtcccataccaactgatagcgaaacgattagaatgtttttagtctggttgaagttgacttgttgtaagatacggaccccttgaaccccgacaattccgaacattaccaacatagctcccccgaggacgctggtcggcacaatggtggcagtggcaccagccttaggaagtaaccctaaaacaataaggaaaccagctgcataatataaaggtttacggcttttaacgcctgaaagctggagaacacctacattttccgaaaaagttgagtagggaaatgtattaaagatccccccaaggatggctgcaattccttctgaacggtatccacgttttaaatcgtcttgagtaatttctttacctaccagatcacctaatgcgaaaaagacccctgtcgattcaatcattgtagttaaagtaaccataatcatggttagaatagcggaaagattaaaggtaggaactccaaaatagaaaggttgaggaattcgaaaccaactagcttcagcaatgggcgataacgaaaccatgcccataaaactagcaaggatggtgccgattaaaataccaattaagatggcgatagaacggaaaaaaccgcgagcccacacattaatacctacaataatcaaaacggtgattaagcctactaatagattacggggatctccaaaacttttagcagcaacatttccaccgccaatatcttgaaaggccacaggaattaaagtaaagccaattacggtaataattgagccggttacgattggtgggaaaagtcctttaattttagagaaaagtccaccaactagaaatacaaagacaccagaagcgataattgctccgtacatggcggtgacccctagagtccctccgatttgctggaggggttggacggcttgcacggcgcaacctaaaacgacagggagaccaatcccagttaggggagtgcgtttaatttgtaagagcgtagcgataccacacatgaaaatatcaacagagactaaataagtcatttgagcggctgtaaaatgtaaaaaaccaccgattaaaagaggaacaataacatcgccagagtacatggctaaaaggtgttgaaagcctaaaatagcagcttttccttcagttaattgtggtttaatttcagttacaggaacttcggtgtaacttgattcagttgttttcatgaattctcatcctcgttttcataattttcaaatcaatatgaaatcgagcctataaaactaaaaaagctcaagacaaaaagtctcaagccatcataatacataagagttagttttcctatagtccaacatttacggcgttgggtagaaactgtcaaccagattaagacattatataggctaagttttatttgattgtgactgaaattttaacatataaaaattaatgaaacaaccattctcaaactagaatagttattgtcgaaaaaattggagaaagaaacaaacagatttataatgtaaaaaagactatttttaggagaaatcaatgaacatattagcaattggaacagaacgagttatttccaaaaaagctttagaagaattaaaacaaaaatcagatttttcagtaattatatgtacgccaaagcaagttaaaaacattgcggcgattaattatgatgtaatgtatgttgatatgcttcacctcggaatggatgaagaatttgaaggaattattgatcaaattgaggctggtgaaattaaagcgaacaaaattatttttctagcaacggctggcatggataaagaaatcaatccaaactggattgaagttcaagatttgaaagaactactattagaagtcaaatatgtggctaaattagtggatgagactgagcttccatatacaattttacgaccagttgaagttagtggtgaagttcagaatgtagctttaaatataattcctgaaggagaaaagattagcgtagatagagttagtgaagctaacttaagaacggtgattattgatgcaattacgaccaataattatattaatcagtcggttggaatttctaataaaggataggagaaaatatgccacttcaatttatgtatggaccggcaagtattgaccatctagaaggtattgccgacagggtaattgaacttcagcaacagaatgtcggtcggccagtatattatttggttcctaatcacatcaagtttcaatccgaaatacaattacttcaaaagttgcgacagagaagagatgttaagagtcatatttttgcagaaaaggatgttcaaattctttcaattagccgattagcctggtttttcttacgaaatagcagtatttaccaatatcctcgcgtaacgagctcgagttctaatatgctgttatatagagtgattttagaacatcaagatgaattaatcttgtttcataatatagatgctcagttggggctggtacagaagattgcaacgcagttagctgaattcaagcaagggaatgtagggcccgacgaattaggtcgagttgcggaaaatattgccgaaaacagcgatgcagggatggatattaaggctaaattacatgatctaggcataatttatagtgcttatgaagaagaaattcaaagccgtttcattgatgctagtgatattacgcatactttaacagatgaattatctaaaatggatctgagtggtcagagttttataattagtggcttttcaaattttactgctgaagaaatgagtctaattcaagccttaatgaaggccaatggaaatgtcattattgatttaataatggataaatttccgctttatgaaaaagtttcagaaaacagtttgttttttgaaaacgaaaaaataattttcaaatttaatgcgtgggctcatgaaaacaaggtgaaatcactagaaccagttcgtttacaccgagttagagttaattctgatcttttaaaattagaaaaatattggatcgaatcaagtgaaggtcaagtaggaggttctaaacaagaaaataacgcatgtgttacgattttccaagcgaatagtcgttatgcagaagtagaacatgtggcgactttaatacgccaaaaaatggctaaagatccaagtttaaaattttcagatttttcagttttaacccgacatttgagtgactattcaacgattattaagccaatatttgatcaaatggagcttccgatcttttatgatcttcaaattgcaatgaaagatcatccattactagaattgattaacgctttgtttgatattagagcacatcattttcgttatgaagatgtaatgcgtctattaaaaacgggtttgttatttccagaaactgaggatgacccgcacgggatggacttcttcaagagtgtgcatattactgaaaattacgttttaaaacaaggaatctatggagaccgatggcttcagaaaaaagattggaaatatagtcgttttaacgatattgatgaagagaagcagacggatgaagaaatcgaaattaatcagcgaattaatacggtcaaaaattatgtagcggaaacagttatgccattttttaatcaactttctactgcaaccactggtgtggaagcagccaaggccttgtatgactttttaattaaaaatggaattgatcaatgcttacttgcttggcgagaccaatggattgaggaagggcgtttggcgaaagctgctgagcccgaacaaacttgggaaacttttatccagatgctcgatgaatttgtcgatattctaggagatcagccatttgacccagataattttatgggtcttttaaatgcgggatttgaaggggcaacttattcgcaaatcccatctacactagatcaaattctagtttcagaaagtggaatggtccagatggttgaccgtaaaattgtatttatcatcggagctactgatcgagtaatgccggaacaaattcaagataatgattttttgaatcaagatggtaaaaatcaaatagatccgttcttagatgatgatcaatttttgagaattagtaatgatcgacagatgcgccaagaaccataccttaattatctaacgtttatgattggttcagatgagttaattttctcttatccaaaaagtggaaatgatggcgtagaattaaaaatctcgccttacgtagaacggattggtaaacattttgggattatcgcccaatcattaccaagtcgacctacaactgagccggttcgactggatccaccatttatcgagctatttattggttccaatcgaagtacattgagtcatttaattcagtatgcgagagccatgcatgaagctaaaagtgaagcagacccacgctggaatctaatttatacaattttgagacagagtacattgggttctttaacagatcagttactaagcagtctggaatataaaaatattcccgaaaaattgaaaccagaaattgtggaaggtctttacggcgatacaatttatgcttcagtatcgaagctagaagagttttatcgaaatgaatattcatactttttaaaatatggattgaagttacaagaacgggaaacatcggatttgagccccgctgatacagggcaatatttccatgcagcaatggataaattaattaaaatgattactactgagaatctgaacttcaatgaagttaatcaagaacagattgaacaaattgcgaaaagattagttcaacaaatggagcaagatcaacaatttgaccagtttaatggaacttatcggatgggatttttgcgaaaacagctagatcgaacggtgcaagcgatggtcgaagcaatctttaaacaactggctcgcacacgaatgcgtccgattgcatcggaacaattatttggtcagattggttcgcaatctggattgccagcattgaactttaaggttggagaagtcaaggaaattaacgtacgcggtaaaattgaccgtattgataagattgaaattggcgataaggactatttaggaattgtcgattacaaatctagtaaccgtaaatttgatttcacagatgcttactatgggttagcgatgcaaatgttaatgtacttggatgtagttcagcgtaataaagaaaagattgacccagctacaaaagcagaaatttcgagcgcattatatatgattttccagtacccgcttctaaaatcaaaagagtggaagggcagcgatgctaaccaacttaaccaaagcatattcaaaaaattttcactaaatggatttttattaaaagatgaggaattaataaaggaaattgataagacgattgaagacaccagaaagtccgatgtatttccaattgcatttactactaagggagctttaacgaaggttagtgaaaatagtatcttaagcgaagatgaacttcaaaatttgattaaacatgcagaattgaaggtacgtgaagctggagaaaagattttcaagggtgagctagatatgaatccggtacagtggcctaatcgaagaacagtgatggaatattctccttataaagatgtcatgcaatttgatgtgatgttacctgagaataattatcgaataattgataagttagataaagatcaagtactagaacagattcgggaggaacaggaaaagaatggcagatagagagtataccttaagtcagaagcaagcaattaatagttccggccacaacattttagtctctgcttcggcaggatcgggtaaaacctccgttttggtggaacgcgtaatccaaaaaattattaatggtgaagatgttgatcgtctattagtagtaacgtttacggaagctgctgccagtgaaatgaaggaacgtattcgagcagcgattgtgaagaagattaatgaagtgagtgatattgaacttcaaaatcatttttcaatgcagctcaataagttgaataacgcgaatatcagtacacttcatgcattttgtatgtcgataattagaaactattattacatcattgatctagatcccacgtttagaattatggatccaacagaaagcgagttattgaaagaaagtgtctgggcggatctccgggaagaattatacgagagggatgaggatggtaaatttgcgctcctcacgcgtaatttttcaagcgatcgttcggatgaggggctgcaagatttaattttagaattatttgagttttcgaatgctaatccagaccctcaagcttggttacagcagattgctaaaaattacgaagttccatctgataatgttatggatatggagtttatccaacagcttttaacagaagtaaaaacaaagttgatgagaatttatcgcaaagacctagatcttacagaacaagcaatcaatggtggagaacctttaaaaaatgcagctgaaaaattccaaaatgaagttgatgatttaaaaactattatcgacagcttagatggtagttgggatgatttacaacaagccgttagcaagatgaagttcgcgcaactaccacgaggtaaaaaagaagaagtccaagaatttaatgcatacgctaaatcaattcgaaatgattttaaagatgagtttaatacaattgcggataaatactttaaattacctagtgagcaaatggttgcggtcttcaaggatgctcacgaattaatgatgaagttaattgaagtacaaaaccaatttgcggaacgctttttacaggaaaaactaacccgccgttctttagattttagtgacttagaacattttgcgttacaaattgttttagatgattctgaagaaggccaagcaatcagacgcgatttccaacaaaaatttaatgaagtcattgttgatgaataccaagatattaatccgcttcaggaaacgattctgacgtcagttgccagtccagacccaggaaatatgttcatggtgggggatgtaaaacagtctatttacgcattccgaatggccgatcctagtttgtttattagtaaaaataatcagtttaaagatgaagaacaagcagatgaacggattattttagcagaaaatttccgttcgatgcgaaatgtcgatgattttactaacttaatttttaaccaagtaatggatactgaagtaggagaaattgagtacgatgatgatgctcaattgcaattcggcgcaaaatactacccagatgaagttcagaataacaccgaggtaatgatttatgacgacagccaaacagatatagatgataaagaagctactccaattatctcaaacaaaaatgacggtcagttacagatgattgctcaacgtattcaaaaactatttgcggatcatactcagatttatgataaaaaagaacaaaaaatgcgggacttagaatatagcgatattgctctgctacactcaacgggtagtaataaccttgagattgttgatacatttaagaaatatggaattcccattcaagttaataatgcccaggattatttccaaaccacagaagtttcaatcatgatggcgttattgaaaataattgataatccctatcaagatatcccattggcagcagttttaaggtcgccaatggtggggctgaaggaaaatgaactagcctttttacgaattggaaagaaaaatgggcattactttgaggcactactttatttcttgaatgaggccaagctagattctaataatgagttccaaatgcagttaaaaacaaaaataactcactttttagagcaattagatcgttttagtaaattagcccgtcaatcaactttggtggacctcttatgggcaatttatgatgaaacaggttatctagactatgttggtggaatgcctgatgggccacagcgccaaaataatctacatgctttgtacgatcgggcgaaagggtatgaggagtctagttttaagggactcttccaatttgttcgatttgttgaaaaaatgcgagataagaataaggatttagctgaaaatccagtagttactgatgtcaaagctgtgaaattaatgacgattcatgggagtaaagggctagaatttccaattgtattcctaattgatgctgaacatggattcaataccatggatgagaaaggacgttacgttcttgatcgagacgcagggatgggaatcacattgaaggactttattcatcggttagagattgatacagtccaaaagaattggattatttcaattaagaagcaaaaggcattggccgaaaaattgagagtactctacgtggccttgacgcgagcagaacaaaagctaattatcactggagcagttaattctgcggatgacaccttgaacaagtgggccgaagcggtagacacggacaagatgttaattcctgcggaagctagatctaaagtaagtaactttttagattggattggaatggcaattatgcgagtaccttctgtggttgaaaaatacgcagattacaatacccgaaaattgcaaggtacactgatttcggatgtagaattgaaaattattaatagcagtgggttaatggatcagcaaggattaacagctttaaagtcagcgcagatacctgagttacagcagttaaacgcttctgatgatatagctgatgttgataagcttaaacaaattatgaacttcaaataccatgatgaagccgcaacgacaacaaccgcctatcagtcagtatctgaaattaagcgagtttttgacgatcctgataaattcgaattgaattttagtgaggttgatgcagatcaacacattaaaccacaaaatcggtttgtaacggaaagtttaatggctccgcgttttatgaatgaagcgacaaagcctaaggcagctgaaatagggaccgcaacgcatttaattttgcaacaattagatttgaatcaaccgattaatgaaacaattattaaagataaaattggtgagttggtaatgaaccgagtgttggatgaacaagttgctaaccggattcgtatttcaacagtattagacttttttgatagtgatttaggacagctaatgatcaaccatccagaaaatgtacatcgggaagaagctttttcgctattactgccggctaagggacttttccctaaagttaaaggtgatgacgatgtgttgattcatggtattatcgatgcatatttcgaaatggaagatcgagttatcttattagactacaagaccgattttgttcttccggggagcgtcgaacaaggcatagaaaaagcaattaatcgataccaagggcaggtcaatttatacgcgcaagccttagagagcattttgaaacgaccagttaatgaaaaatatctttatttgttatcgattggacgactagtagaaattcaataaaaaaagctgcaactaatctaatatggcaaaattagttgcagtttttttgcgaaaaagtgttttaagagaccactagattaagagatggggaataatcctgaagcgcgttttaactacagatgaacttcggagcaaaaaaatgtggataattgtggataactttgttaataactaaaaaagtacgaaactatttatacacaaaagttattaaataaaccttaaggcctgtcgaaaagttatccacaggcagtgttgataactgtggataaaaaagtttataataattttatattgataaaaacgcttatttgtaggcgatgtaagcgtgtggaatgaaacaaaaattaagttgggtaattgtggataactaaaaaaactgttgacaaaatcttatccacaaatgtagtgccgaacataaattcgacccaatatgttgtgagtgcaaaaattagcctgtggataactttgttaataacttaaaaaaggatgtgcaaaagaagtgaatattaaaattattgttgtgggaaagttaaaagaaaaatatttgaaacaggggatagcagaatactcgaaaagattgtcaaaattttgtaagttccaaattattgaagttccagatgaaaaagcacccgaaagtttaagcgatgctcaaatgaatgaagttaaagttaaggaaggagaacgtattttaggtaaaattaaagatcgagactatgtttttaccctagaaatcaaaggaaaagaacgctcttctgaagaattatcagcagagatggctaaattagctacttatggaaactctgatatcacatttgtgatcgggggttcgttaggtcttagtgatgcagtaatgaaacgttctaattccgccatttcatttgggcgctttacactaccccaccaattgatgcgactagtgttaactgagcaaatttatcgttcgtttatgattcaggcgggaagtccgtatcataaataaagaattcaataatatacttgtacgcttaataaaatattagaagaaacgactttccatgatgaaagttgtttttttgtaaacttaaagatataaaataattggtagtttgaaagttataatataagtaaagtctgaaatgaatggggtataaacttatgaaaaaaaatatcgatgttgttggagctgcttttatagaagatgataaaattttagctactaaacgtagcgatgaccgcattttaggaacgctttgggaatttccaggtggaaaaattgaaaaaggtgaaactccagaacaagctttgaaaagagaactatttgaagaatttaatgacgacatacaagtcggtgataaggtaacagatacaagtagttttgaatatgattttgggactgtaaatcttacagtatactatgcaaaatttataactcataattttaatctaattgctcatagtaaagtagaatggatgtcccaggaagagctaaaaacagtaaaatgggctgatgctgatcaattagcagtgggtgagatatgtaaagctgatctttcgaaggtgaaattcggatgaaattaacaaaaataaaaaatgaaattcaaaatgctctgacacaaggttttgtggataaagatattattgggaacgaagaaatggtgccgcggttcattttaaatgctaaaggagatacaatgcgtgatcatattgatcatgagcttattcattgttcatcatttatctttgtaatagcgtttattacagaaggcgctcttacaccgttaaaagtaaaactggctgatttagctcgaagaggtataaaggggcgaatactgacttccgattatttggagtttaattcgccaaaaatgttctatgagttaaaaaaattaaaaaatgtagaagttagaattgcagatattcatacttttcatgctaagggatacatttttaatcataatgatgtttaccaaactgcaattataggtagttcaaatcttacagaagcggcagtagctactaattatgaatggaatcttagagttacatcttaccaggatggagaaattactagaaagataattgaggaaattgaaaatcagtggaaaaagtcacactctttaacagaaaagtggatcgaagagtacaaaattaaatatgaaaaaagccaacaacgctatttaaaagcaaaaattgaagaagaaattccagagtatgaaacttcaaaagagatcaaccctaacttaatgcagcaagaggctttaactaatatagaaaatatccgatctaatggagctcaaagagcactagttatctcggcaacaggaacgggtaaaacatatttgggggcatttgacgtaaaaaaatttagccctgataaatttctatacatagtacacagggaacaaattttagataaaactatatccagttttaagaagattcttagcaatgaacctgcagaggcttttggaaaagtatccggaaattcaaaagattttttgaagggaaatacctatttgctaccatacagacgctttcgcgagacaattggctagaacgtttcgataaggatgaatttgattatatcttagttgatgagacacatcgggctggagctgaatcttataaaaaagtgttaaattattttactccacaatttatgctaggaatgactgcaacaccagacagaatggacaattttaatttatatgaattgtttgactacaacattgcatacgaaattagactgcaaaaagctttagatgagaacatgttatgtccgtttcattatattggcattactgactatgaagtagatgggcaaattactgacgacactagtcaactaaattggttagtatctgaagatcgtgtagattacgttattaaacagactgaatattacagttactcaggagaagctctccaaggtctaatattttgtagtagaacagaggaagccaagagattagcggaaacacttagcttgaagagacatcctagtaaggcattaacaggtgaaactcctcagtgggaacgtgaaaagattattaaggaactggaacaacggaaaatagaatatattattacagttgatgtttttaatgagggtattgatataccatgtgtaaatcaggtagtaatgttaagaaacacacaatctagtattgtttttattcagcaattaggacgaggattgagaaaatcagaaaataaaaaatatgtaacagtcattgattttatcggaaattataaaaataactacctaatccctattgcactagttggtgataagtcgcgggataaaaatagtgcacgagatgatttggaattaaatgaaattgcgggaatatccactgttaatttttcggatattgcaaaagaaaagatttatcaatctataaataatacatctttagatagcatgaagatattgcatgacgattatgaagatttaaaagcacgtttaggaagagtccccctcttattagattttcaatcttttggaacagtaaatagttccgtttttataaaaaaatatagaaattattaccagtttttgctgaaaatgaaggaagagtttcatttgactcatgctgaagaagagatcctaactttcatttctgcagaattaacgaatggaaaaagaattgttgaacttctattattagaagaaattctagaatgtgatggacaattagtaaagggagattttataaagtctgttagagaaaagggaattttttataatgaatcggtagaaaaatctgtagaacaagttatgtcattggaattttttaaaaaagctaatcggaaaaaatatggaatggaacaaatagtaaaagataacaagaatatctaccaaattagtgaaaaattcaagaatagtttcgagaacaatcccgatttcaaactattagttttggatgcgataaaggcgggactggaaaatgcaaaagaatacgatataacaaaacctttttcattatatcagcggtattctagaaaagacgtttgccgaatcatagggtggacagaaggagatagttcaaccgtgtacggatataaagttaaggaaaatgtctgtccaatcttcgtaacctattctaaatctgatgccatagaagatagtattaaataccaagataaatttattaatagagatatattccagtggtacactcgtcacaatgttaaaattgattccaatgaaatgaaaaaaatattaaataaaaacacgactatccaattatttatcaagaaaaatgatgatgaaggtagtgatttttactactttggggaaattaatgttgttcaagctgaacaagaagaatttcaaattaacagtgataaaattgaacctatagtcaaagttcaattgaaattaaaaaatactgttaggcaagataagtataagctttttgaaaagtaatgtggttgctgaaaaataacatcgatattaaaaaagtttgaagctagtttggtacaaaagtatgagaaaaatatttcaaattatatgaacaaataaaaaacgcctaaaaaggcgttttttatttatcctaaccattttcccacaattggaaatttgccttgcaaccagacaaatggtcgggtcttaatgatacgttggtgagtttcaggtgaagctttttttacagagattaaagcgagaatgaagaatggagaagctggcataactggtagcgctaagccgattattcctaggacagtattgaagaaggcagaggttagccaaaaaaatcgtgtgattatgaaagtcatttagtcatctccttaaggatataagttagcatgttttagtaaactaaacgagcaaaatggatgagcttttaaagttacttaagaatattaaatgaatttttagacagtttggcttataatgggcgctaaatatttgaataatacaggcagaaaaataagatcgataatttcaacttcaggtgaagttaaagtgaggtgagaggtaatgaaaaaaccgaaggcactagtacgcggtgataaagtagcgatcgtgagtctatccagtggagtattgggtgaaagctttgctgaacacgaattgaagcaaggaatacaaagactaaaagaatttggtttacaaccaatcattatgaaaaatgcttgtcgagggattgaatacttaaaatgtcatccagaggccagagctgctgatctcaaacaagcttttatgacagccgatattaaaggaattatttgtgcaattggtggggatgatacttatcgtttagtgccatatttgatggaagatgaagaatttattagggcagttcaggcgcatcctaaaatttttacgggcttttcagatacgacgatcaatcatttaatgctaaataaactggggctaataacgtattatggtccaaacctattgaatgatttaggcgagctagataggcagatgttgccttatacacgagaaacttttgctagctatttgaaaaacgaaattccagtcgaaattaaatctagcccaatttggtatgatgaacgggtcgatttctcgataaaagcactgaacacaccacgtgttaaacatgatgaaaaacatggttaccttgtacttcgtggaaaagggaaagttacaggaagattattcggcggttgtttgaatagtttgggtaaatgtgtcttaggcgaaggtcactctgatcaaccagctattattcaaaaatatggcctattacctgaacccgaaaaatggttaggaaaaattctgtttattgaaacaagtgaagagaaacctacgccaaaagagtatcgaaaattattagaaaccctagatcaatttggaattatatctaaagtttcagctataattgttggaaagccacaagatgaaatctattttaacgaatatcaaaaaatattacttgaggtaacagcggtttatcaaactccaattatgtttaacttaaattttgggcatgcttatccccgaacagtaataccctacaatttagaagttaccgtcgattttgatgaaagaactttaacagtccaagaatccttgttcaactaaaaaaatccgcctttaaaaggcggatttttaattatctgacgataatattgccatcggaactagtgaaagaataatgagttttctgagatccttgatgatagtaatttgtatttttaccaaaaattttaacgtgcccgtcgtcgctatctgcattaattgctagattacgggaatccttcagagtagtatgaatatcgccatcactagtacgaccggttaaagattctgaaatactaagccgatttaagttcagatcgccgtcatcactaactaacttaagctgtttgaagtcagaatcattaagttcaagatcaccatctgaagttaaaatttttgatgagcccttaatgaattttgagtcattaatagtaacatcgccatcactgctatcataagcaagacttgctgctgaaacttgtcgtaactctaaatcagagtaaccactaacttggagttcgtctttaacgttaactttgtgcaaatcaacatcttcatttgaagatagatggatttggttgaagttcaaatcagtaatagaaactgtaccactagtgttacaaattaacttgttaagtttactagtacttggtacataaatagtaatcgtagacggtgcaaagtttccaagtcctagattaaaggtaaaaccatttcttgaattatcgttaatagaaagttgatggttggctgcttggtaatcaagggtattggttcctcgataagtgactttaatttgggatccagcgtaaggtttaatttgaacatcatcatcggcgttgattttcaaattatgaacttctttgaaggtagcatgtttgattgaagtatcttcgattttgaatccaccatcatgccaaattaaattatgatcgccgtgatgtaagatgcctaatcctaaaaggacggctcctaaaatggtgatgataatccccgaaataagtgtttttttcattaccgatcacctcttttttctgttcttcttgtgacaatcttggcatataaccatctaaagaaaagggaagtcccgtgaaggattaatattaatatccatcgaataaatggaattaaaattaaatatattccgattactaacaaaccaaaaccgatgtaataaataccagtccaaaaagatgttgccaaaagagttagaccaataataaaaataataatagcaatgatgccaaagatagtgaaagccaatccaaccccaagaactgcaacaatcattccaaaaataacaccaaatatggccataaataagcctagcgctagaggaattgtaataggggtagagaaaatggccaggatgatcaaccaaatggttttaacatcctgccgtggacgtttaaaatccgacgattcgggttcagattgttcaccagctttaatagaatagtctgctaagattttccgcgccaattgtttaggtgttcctaatgaagaaactgcttgttgatagcttaccaagccactatcttgtaaatattcgctataaaactcaatcacgtcagaccgttctgcgcgcgtgagcggagataaatgggactctaattcttcaatgtaatcattcattcaaatcaccccttgaaactagtttatcaatcctatttttgaaggtaatccattctgcttgaatttcagctaaacgaactttacctgcttgagttatcttgtaataccttcgattacgtccttggtagggttcatcataggttgttaaataattattcttttttaaacggcgtaagacaggatacatggttgattcagaaatcggaaagtctgcttgaactttctgtgtcagagcataaccatagtaatctccatgatttaatattcccaaaacgctaccgtctagcaattcggttggaatttggattgccatatgttcacctccataatactatatctcatatagtattataaatgattaaaatagtaaagaaaacccccaagcttatttacaagcttgggggttgaagttcaatttaacgtaaaattcgttggatatcgcgagcaatcattaattcctcattagttggcacaacgagaacttgaaccgcatcagttacttgattaatctgttgttctttaccacgtacattattacgctcaacatcagcattaatgccgaagcaggtaagttgttccataatgcgttctcgcattgcaattccattttcaccacagccagcagtgaaaatcagagcatctaatccaccaagttcagccacatagctaccaataaaacggactacgcggttaatgaacatttccaatgctaacttagcttgaggattagaattttcggcgtcttccaaatcccgttggtcaggagataattgggaaattcctaacagccctgatttttgatttagaatatcaatcacttcgttaacactaatccctaatttttcagctagaaaaccgaccagtgatggatctaaatctcccgatcgagtcgccatcattaccccgcctaagggagtgaatcccatagaggtatcgattacacgtccttgattaaaggccgtaattgatgaaccggaaccgagatgacacgtaatcattttcaaatcgcttaaatctttttttagaagatctgctgcccgattggcgacataccgatgactggtcccgtgcgcaccatatttacgaatccctaagtctgtgtagtattcgtaagggatgggatagaggcggttaactttcggcatatcagcgtataacgaagtgtcgaaaaccgccacttgacgaacatctggcaggagctgtttaaaaatttcaatgtagcgggcctgagccgggttatgaagtggggcatattcagctaaattgtggatttcggctaaaacttcatcatcgattaaaaccgagtctttaaagtgttcgccccctgcgacaactcgatgtccaattccagtaatctcacgtaaatgcttgactagtccatgatccttaaggaaagaaagcagcatggtaaccgctaaatcataggtgattgaaggttttactactttataaggatcgtgttggggacgtttaaccgtaaaaacggagttgggaagattgatccggtcaatcaatccagttgcgattattgtttcatcaggaatcgaaaacaacttccatttcagagttgaactgcccgcattaataactaagtcttttttcatgagatattcctcgctaacatgtgtatatttattggaaattagttttttgtatccgcttacaattataccggatttccaacaaaaatacttaactatcgataatagtttttgcgttaatgaattcacgaatacctaaatcgctaagttcacgtccgtaaccagagaatttaactccgccaaatgggaactgaggatatgaagttagtaattgattaatagcaacttggcctgtttcaatcttcgaagctactcgttcagcttgttctaagtcttcggaaaatacggtcccacctagtccgtgttgagaagcattagcaacttcaaccgcttcttcttcatccttaaccttgtaaacttgagcaactggaccaaatagttcctgatcatacatcgggttatctgatttcataccactaatgatgagaggataaaagccagcaccagggcctttaatgggcgtattgttgccccaaagcagtttagcaccgccggctaaggccatgtccacttgttttcttagtttttcttgagcagacttggatgaaagtggcgccaaagttgtttcgggatctagtgggtctcccaaccgacgttttgcaaattgctggctaagaccttcaagaaaggcgtcgtagacatcttcttggatgataaaacgtttagcggccgtgcagacttgtccagcattgctaagacgagctttagcagcaacttcaattgcttttttcaaatcagcgtcttttaagacaacaaaggcatcggttccgcctaattccatggttgattttttcaaatttgctcctgcttcggacgcaatctttttaccaaccccttcagagccagttaaagcaacaccttgaacccgatgatcactgatgatttgactaacttggtcgtaattgataaataaatttttaaatgctcccgttggaataccaactttcaaggtcgcatcctcgaaggcttgagcacattcgggaatgatactagggtcttttagtaagacagggtttcccgcaataaaattaggagcaaagacccgcataatttgagcatacgggaagttccaaggttcaatcataaagactgctccaatcgattggtactcgacgtgggctttaacccctggagcatcgtgatactcaacgtctgccaaagctgctgctccatttttagcatagtattctgcaaaatcagaggtcttttgaacttcagcttgagattccttaaacaactttcccatgttagttgtaataaggcgagcgtaatggtcaatgttatttttaaactcatcggctagctctttaagtttttcggctcttttttcaatgggttgagtttttgcaaattgataaaaaatatcagcattcttcaaagtaacttcgacttcttggtcggttgtattgggaaatgtgcgaattaattgtccgtcgtacggatttactgaatgatatgccatataaaagtctccttttctagatatggttctattgtgcaaaagaatacgctttcattcaagtgataaagcttagattggcaaaattcaatatttgggaaaatacagcacattttatagagtgattagaataaagtgaaggttcagatttgcaaaataaattatcttagcgtagactacagagcgaaaactgaatagatttcttcggggcagggtgtaattcccgaccgacggtaacaaccaagggttgaagtccgtgacccgcgagtagcggtggacctagtgagagtctaggaccgacagtatagtctggatgggagaagaaacgttatttaaatttcgtactcttttgtacgctttttggcgtgcatgctcgtatggagtcttatttagctatcaaaaatcatgccccgcacaaattttgtgtggggcttttttcgtggggtgattttgattagtgaacaagattatatgaatctagctttcgaaatggcagagaaagggaagtatcaaacgtggacgaatcctttagtgggagcggtaatcgttaagaacaacgtggttttagctaaagggtatcatcaccagtttggagctgctcatgctgaaattgatgctttgcagcatttagatgatttaaaacaagccagaggtgctacgatgtacgtcagcttagaaccgtgcagtcactttggtaagacgcctgcttgtgctaaaaagttagctgaagtaggtattaaagcagttatagttgggcaaaaagatccgaatccattagtcgcgggtcgaggacttcaaattttaaaggatgctggaattgaaacaaaagttttgaaccaaactggaggattaaatgttaaatacaattttttctatcagcatcagcgtccatatgtaaacgtaaagtatgccatgactttggatggaaaaattaaccagcaggtcaaccaacgcagtattatcactggtaaagaagcctatcaagatagccagcaattacgggcagaataccaagcaattttggtgggtgaaaacacattaaaagttgatcatccccaattgacggttcgccaaatcgctgtttatcagcaaccttggcgaatggttttgataagggatgtagatcaacttaaagttgaagattatgcgttttttaaaacagcagatccaatcttattacttacttcatccgtaactcgacgacagtggccgaataacgtagaagtgatttctgatcggtggacccccaataaaatcctaacgctactggctaaacgagggattcaaagtgttttagttgaaggtgggagacaaattcacgccgagtttttagcaagcggtctggtggatgaaattaatgtctatcttgcaccacgtatttacggagcgacggggttaccagcgatatttaaccctactcaattaccatatcaatcgaatgcatatcagttagttgaaaaaatggaattggggccagatatgaaatttagactgaggagagtatagatgtttactggaataattaaagcaaaaggcattatcagccagattaaacgcaatcaagcaaccgcgcaaattatgattgccacaccgatgacccaccaaattcatagcaaaattggagatagcattgccatcaatgggatttgtttaacgattactagcattttaaacgaaggatttaccgtcgaagtaatgcccgaaacaacccatcgaacgagccttgcgaatatgaaagatggaatggaggttaatctagaaccggctttgctagccacagaccgcttagatggtcattttgttttgggacatgtagatacaacggccaaattagttaacagggtgttaaatgaaaattcaatcgtcctaacctttgaaattaatcctgattatatagattacgtggtcgaaaagggctcgatcaccatcgatggagtgagtttaacggtttcagcggtggagaagcaactgtttgaagttagtttgattccacataccttacaagtaaccacgctaggtaatttaaaggctaatgatgttgtgaatgttgaaactgatattttaggaaaatacattttaaacgaaaatcgtggtgtaaataatgaaaaatagaataattgaaaaaattgaaaatgctctacaaactttgaaaaatggcggcctcattatcataacggacgatgaaaatcgtgaaagtgaaggagacatggtggggttggccgaatatgttaccccaaaagcggtcaatacgatggttaccaatgctcgaggactgttgtgcgtaccgatgagtgcggagatagctcaaaaattgggattatcaccaatggttactaatgcggaagatgcttttggaacggcgtttaccatcagtaccgatgctaaaaccactaaaacagggatttcagcttttgaccgcgctaaaaccattcaaaagttagcggatccccaagctaaatttagtgaattttatcatccagggcatgtctttcccctaattgctgaagagggtggggtgctagcaagaggtgggcatactgaggcggcagttgatctggctaagttagctggagctcggccagtagcttacattacggaagtcttgaaaaaagacggcacaatggcacgtcgaaatacccttaaatccttggccgaaggaatgcaaatgcccctattaaccattgaagaaattaaaatgtatcgttatatgaaagatgctggaatagttaaatcggttacgaaagtccatttacctactaaatatggagaatttgagatggaagcttttgatacgggggctgggcaggaaccaactttacttttaactaaaggaaatctatctgaagttcaaccctcgttacttcgaatccactccgaatgtttaactggtgatatttttggttccaagcgatgtgattgtggtgagcaattagaacgttccttaaaggaaatccaaagccgtggaagaggagctttgttgtatttacgtcaagagggtagaggaattggtcttgctaataaattaaaggcttatgaacttcaagaacaaggaatggatacagttgaagctaatcttaagttaggatttcaagctgacgaacggcattatggagtagctgctgcaatcctaagaaaaaaaggaatcacgaaagttaatttactaaccaataatcctgacaagattaaataattagaaacgttgggtatcaaggtagaggagcgagtgacaatccaaatcccagcacgccccgaaaatcgaagctatttaaaagttaaaaaagaaaaaatgcatcatttattgaaaggaatggattaaatgacagaatatttaggtagccttaatggaagtaaacttaaaatcgcgattatagtagcgcgttttaatgatttagtgacaaagcgtttactggatggagcttttcaaacattagctcaaaatggagtttccaagaaagctatcgatatttattgggtacctggagcgtttgaaattcctcgcgtagctcaaaaaataagccggaaaggtaatgtagacggaataattactttaggagcagtcgttcgaggcgaaacatcgcattatgaatcggtttgttcaggagtaacaagtggaatcgctcaaatagcgttagaaggaaaagtaccggtaatgtttggggtgctcatgacagaaaatatggaacaggcccttaatcgagcgggtggaaaagccggaaataagggcggtgaatgtgcaatggggctactggaaatgattaatattgagcaaacaatagatggggagtagtgatacaaggatttagttgttgttcaaaaaagtggtctacggaggttgaaaccaatatttttttaaaaaactttagtcctttagaccacggtaaatttaaatatgtagttttttaaaaaatagcgctttcaaaaaccgataataggtaataaaagaaaccattgatgaaaacgagtaatgctgcaatcaaaccgaaggtgaaatccgaatacttaaaaattgaaaaatcgagtaaaggatgcttaagttgtttctcggtacgaataaataggataattgaaaccacggcaatccacagtgctccaaggatgattggatgggtatacccaattgcttgccctcgtaaaatagcaaagaagaaagttacaataaaaacaacaaattctagtgtgcctaaccagtcgaggggcgcattggccgaaacaggaacatcttttggtaaacttttaagtcccaataaaatagcaattattccaattggaacattaatccagaaaatataattccaaggtaagtagttgagaattaaacctccaacggcgggtccagcaactgatcctagagcaacgaaagttccgatgaagcccatcgcccgcccacgctgattgattggaaaggaactagtggtgattccaaagctatttgacatagtcatcgctgctccaaccgcctgaacaccgcgagcaaatagcaaaaatggtaacccaagattgattccagcgattaatgaaccaataataaaaattgccgtgccaattttaaaaatgcgggtcttaccgaccacatctcctaggcgaccaaaaaacatgagtaaagaactaattataatcaggtagatggatacgacccattcaatctgacttgctgtaacagataactccttagacataatgggcatcgcaatgttaacgattgacccatctaatgttgacataaacgtgaacatccccagcgcaattaggattaaggttttgttaaccgttaatcctttggatacattattttgcatatccgtccccccaattcatctcttaaaaattaatacaattaacattgtggtgctttaatgcaaaaagtcaattatttttaattgggatggaccgtagaaggacgaggaaattttgtgtgggttaaataaggactttcacttttaagctaagttggtttaatcagtggcacgacaaaaagtagcaacgtcttataaattaagtcggatgctacttttttgttacgtaagggtatttacagtaattctctttgaactaaagtttcggcgatttggactgcattccaagccgctcctttaagtaaattatcagaaacaacccagagattataaccccctggattttcagcgtcagctcggattcgtccgacgaaagtggattggtgtccttcagcggtgagaggttgaggataaagctgagtacggggatcatcttgcaaaacgatgccatcagcttggtccaaaacggtctgaatttctggcaccgatggattttgttctaattcaaagtatacggattcgccatgcccgacggggacaggaacccgaacacaggttgccgttacttttaaatctgaattattcaagtcgtggcgtaaaatttttttggattcatgaatcattttccactcttcatgggtataaccgtcatcttcaaaaacatcgatttgaggaagtaaattaaatgctaaaggataatgatgagatgcgccactaactggcaaaattttagctatttcagcttgcccatcaagatgttggcgagcttcctctaatagttcactccaagccgattgaccagctccagaagcagcctgataggttgaaacaataatccgatttagaccgtattttcgatcaagcggggcgagtgctaccaacatttggatggtactacagttaggattagcaattatcccgtgatgccaatcaagatcatcagaattgacctcgggaataaccagggggacttctggatccatacgaaaggcactagtgttgtcaatacagaccgcgccgttttttacagcgtggggaattaattttttagaaactgagccaccagctgaggataaaactaagtccaccccgataaatgaatcaggagttgcggcggatacttcatattcttgaccgcgaaaagtttgaactttgccgacggaacggggcgacgcgagtagtcttaaatcacgaacttcaatattagactgttcaagttgctcaatcattctggttccaacggcgccagtggctcctaggatggcaacggtgattgctgacatattatttttcctcctgaacaaattttgtaagccgtcgaacggcttcgtgtaagttggacatggatgctgcatacgagaaacgtaaataaccttcaccaccagctccgaaaactttgccaggaatcacggctaatttagcttgatgggcgattttcaaggccaactggttcgaattttggatcaaattgatgggaattttagcaaaaagataaaaagtcccagcgggcgagcgaacttgaaaatttaattgattaagttcctttacaaggtagtcacggcgtaaccgatactgttcgcacatcttggctacatcgtcttgaccatgtaatagagcctcgatcgccccctccataatactagtgggagcggtggtaaccatgaatccatgtaattttaaaatattactggtgagcgtcgccggagcagctaagaaaccaatccgatagccagtcatagcgtacgatttagaaattccattaataagaatagttcgagaaggtagcagttcggctatggaatagtgcttattatcgtagctgagttcaccgtaaatttcgtctgctaggacgaatagcttcgaattttgaatcacctgggcgagttctgttagcttgcttttagagtaagttgcgccggtcggattagttgggtaatttaggactagcattttggcgttcgggtgcgcttgtaaagcttgtttcaaagcatcggctgtgagtacaaaatcagtatctgaggtatcgatttcaatcaccgtggcatcaattgcttttgcaattgccatgtataaaggaaaggttggagttggaataatcacttcgtcgccaacactcaaaatggtttgcatggtagcaaaaattgcttcggtagcgccgattgtgatcaagatttcactcgctgggttgtaccgaatattagttgagttcagtagatatttactaacagcttggcgcaaacgcagtaagccggccgacggagcgtagtgggaggcattattagtgattgcgttaattaaaacttgtttaacgtgttctggcgtgtttaagtcgggctcacccaacgttaactttaaaattcccgggatatcagacacttgctgatcaaattggcggatggcagagcgactaattgctgagagtgccggccgagtttggttttgtagaacggaatcgagttcaggcatttatagagccccctaatctaagatgttttctagaccaaccactaaggtatttaaattggtcactttttgacaagccagtcgaactccagacatgaaagattggcggtcaaatgaatcttgacgaatggttaaagcctcaccaggtccaccgaagagaacttgttcgtgggcaacgtagcccggtaaacgaattgaatggattggaacaccatcaactttacctcctcgagcaccagggatagtttcaatttcatcatagtcgttagcatgagtacgagatgcgctgatggctttggcggtggcaatagcggttccagatggagcatcttgtttatcttgatgatgcatttcaaccacttcagcttctgggaaatatttagcagcctgcttagcaaattgaattaaaaggacagctgataatccaaaattaggagcaattaatcctcccaactctttagtagctgccaaagtttggagctcatgcatttcggacgttgaaagaccactagttccaacgaccggatgatagccatgggtaattgcatacttaatattttgaaaaacaatggaggggacggtgaaatcaatccaaatgtcagcttgcggaagttcagctagctgattagtgaccaaataatcagatgtttgggggatggcatgtggtgcgtaaccaccaactaactcgaaacccggtaagttttggattaactgaacggtttgttgacccatagatcctgtacaaccagcaatcacaacagttttaacctgatttatcatataatggctcctttcctagtaatgcaactgcacgtcggcaagatgattaacccccagctgatgggctaaattgagcttttctttttgatttaatggcaagataggaagtcgtggactaccaacggaccaattttgagcgtttagaacggctttaactggtgccggtgacggatataagaagagggcttccattttgggtgttaattctcgctgtaattttccggcttttaatagatccccgtgtttcacagcatctaaaagtgctcgtatctgatagccatatatgtggcttgcaaccgaagcaaccccatttgcgcctaaagcgactgcacccagagtttctggatcatttccggtatatacagcaaaatcattgggggtgttttcaactaaaaaaccaatgtcatttaaatttgtacactgtttaattccaatgatatttggttcttgagaaagctcaacaatggttgcattttccatttgaacaccggttcgtccgggaatgttatacatcataatcggaaagtcagcttggcgcgcgacggctttaaagtgcgctaccatcccgcgttgattaggcttattgtagtagggggtaacgactagagcggcaatgatcccgtcaatttggcgaacttctttagtgaagtcaatggtagcttgggtattatttgatccggttccagcaatgatgggtactcgtccagcgactatttcagcaaagcgagtatacagacctaatttttcagcgtgagttaaggtaggtgtctcaccggtagttcccccgataataaaaccagtattgccggtttcaatgagatgattagttaaacgttctaacgcagtaaagttaatttttaactgatcgtcaaatggtgtaataatagcggaaatcaaatcaacattttcaagcatatttaagcccccttggacattcgattttgaagaaatttaaccactgcatcgattcccaattgaatggcacgttcatcgggattaaaggtagcagagtgaagtgaactggtagcgccgacgcccaaccaaaacatggtgcctggaaacttgctcagcaagaatccgaaatcttcgccggtcattgctggcggagtttttttaaacttaatggccgaatcgctttgcatgaattgaattaattcatgagttaaggttggatcattttccactggtaaatacccaccttgattcattttgacctcgacttggcaattaaaggcttgggcagttccttcacaaatttgttgaacgcgttgttgaattagaagaatcattttctgagttaatccgcgaatagtgccctcaatgacggcttgatcagcaataacatttcgaacatttccagcagacacttttccaagggttaaaaccccgccttcgatggggttgacattacgagcaacaacggtttgaagctgagtaattaaataagcttgagcaacaaccatatcatttgcgtcttgtggataggctgcatgtcctcctttgccggttaatttaagattaacttctgtagttccagcaaacagggttcccatgcggcaaccaattacaccagctggcaacgtcggcgtactatggagcccgtaaaattcgtttggtctaaactgattggtaaaaatatttgcattaaaagctcgaaccgatccactatggctctcttctgctggctggaaaaagaagattagattatcttgcggttgatggttagcaaaatattctaagatgcccaaggcaaccgtcatgtgaatatcatgaccacaagcgtgcataatacctggagttttggaagcgaagtcaaggtcagtcttttcgttgacaggaagtgcatcgatatctgctcgatatccaattgttcgatgaggatgcgaaccagcaactcgaactagtaaagcggttggtagttcgggaatggttttaatttcaagcaagttttgcggtagcgagcggatgacgcttaaaagtagggcgtgggtctggaattcttttagggctaattccggtgattcgtgaaactgccgccttattcgaactaaatttaatggttcaatggtcattttaaacacttccttataggttacgtagtccgtcttcaagcgctgttttctgggaagttgtattatcaacccgtttaataatttgagctggtaccccagcaactactgtatgtgcaggaacgtctttggtaactactgctccagcagcaacaacagcaccggttccaacatgaacgccttcaaccacaacggcattggctccaatcaaaacatgatcatcaatttgaacgggttgagcggaagctggttcaattacgccagctaagacggcacctgcaccaatatgacaatgtcgaccaactagagcccgcccaccaaggacgacgcccatatcgatcattgtttcggccccaatctcagcgccgatattaataatagcgcccatcatgataactgcattattgccaattaaaacttgatcacggatgatagcgcctggctcaattcgggcattgacttcctttttgtccagaagaggaactgcagaatttcgactatcgttttcgactcgatagtgtgtgatttgagaagatgattctaatagtgctttaacgtatttccattcaccaaaaagagttccagaagttggtgaaataaaagcttcaatttcattcggtatttgtaattgatatagtttttctccggcaataaacactcgaacgggggtctgctttttggagtttgaaatggtgttaataatggactgggtgtcaagattactcatagtaattcccctttcaattttcaataatctaaatcattttgtatcatatctgcgtatgtttctctttgaataactaattgagcttggctattttcagcaaagacaactgctggacgaggattacggttatagttactagccattgaatacccgtaagcacctgttgccaacataacgagtacatcaccggtcttagtagtaggtaatggaaggtggttgattaagatgtcaccagattcacagaatttaccagctaaacgaacggtttcaatcggaggctggtttggattttctgcaaggaccgcctcatagtcagcctggtaaagtgcgggtcgaatattatcacccattccgccgtcaacagcaacgtaaggggataaaccagggacatcttttcgtgaaccgattgtgtaaagtgaaaaaccggctggaccaacaatggaacgacctggctctatccaaatggtgggaatgggttgtccaagcttagagtactggacttgaagttcatctaaaatttcaccgagaagaagctcgggggcaagaggatcattcgcatgggtatacttaattccaaatccaccaccgatatttaaaatatcggctgtaaattggtatttttgagaccaatttgttaataaattgactaactttttaacctctaatttaaaacctgttacttcaaaaatttgtgaaccaatgtgggcatggattcctcgtagatggattcgagggttgttttgggacaagcgcatggcttttaatgcttgtcctgaatcaatatcaaatccaaatttactgtcagtttgaccggtttgaatatagctgtgagtatgagcagaaacacctggtgtaacacggagcaacacatcaatttgagtattattttcgttcaaaacttgatcgagcaattctaattcatgaaaattatctaaaatgatagttcccactcctttttggacggcaaaattcaactcggcgagtgatttgttattaccatggaagctaagactagcagaggggaaaccagcggccaaagctgtagcaatctcacctccagaaacgacatcggaatgggcatgttcttgcttgacaacttgataaatggctttgcaactaaaagccttggaagcatagctgacgatgccgcgcataccacggtcttcaaattctttttgaaaggcttgaatttgattacgaatcatggtgacgtcaaaaacttggagtggggtcccatattgacgggcaagttgagtagcgcttaggccgcctatggtaacctgattaacgttatttacggtgtataaagacattcgtttacccccttttctaatttaattttcacaaatttataatactaaatgaatttcgtcaagcataaagtaagggggtatatgtcataaattgttgctctaagtagaagtgatttatgaaaaatttatttttttgcattctagtacagaatgagtataataggcttaaattaaaaaagaggttgcggagattaaaagtacctgaggatagaatgaaggattcgatatgccccagcgaaaggatgatccgccgaaatgaacattgacctttctcaatgtttgttgggtcttgagataacatctcaaggactgtcgctatcatgactgatagcggggtgcttttcaaatcagactaatgatttagcgatgttagttaattactagcgcccattttcgtttttttacgaatgggcgtttttattttggttagttggaaagctagaacctcgcaaaaggagactagtatggtaaaagttgttaagtttggtggtagctctctagctaacgcagcgcaatatcaaaaagtaattgaaatcttaagagcagatcccgaacgtcgaattgtggtcgtttcagcaccagggaagcgtttcaaagatgatgttaaggtgacggatctattaatcaaatatgccaacgcatctggggagaacgtcaaagtagcacgtcaagcagtgctagaccgatatcaagaaattgcagatgcataccacgtttctgattcggattttgaacaaatcaatgtacatctaattgatttagcaaatttgcaccacgcaaataaagcatgccgtcttgctcattttaaggcggcaggggagcggttaaacgcaattttaatggcattagttttaaaaaaattcaatgttactgcgcgatttgttgatccgaaacaattgggcataaaggcacatggtgactataataacgcgatcttagaccagcattcatatgctcaaattgaggcagtttgttcaaatttgctggatgaggcggagtatcttgtagttcctggtttttatgcatataaccaaaatggtgaggtatgcactttctcgcggggagggtcagacatcacaggggccattctcgcacgtggtttccaagctcagctttatgaaaattttacggatgtggactccatttattcggctgaccctaaaatcattgcccagccacatccaattcgagagatgacttaccgtgagatgcgggaacttgcatatgctggattttccgtttttcacgatgaagccatcatcccagcaattgaagctcaagttccaattgtgattaaaaatacggatcatcccaatttaccaggaaccgtaattgaacccgaacaaaattatgcttctgatttagaaatcacaggagtggcgagctcaagtcggtttgcggctttgtatatacacaaatatctgttgaatcgtgaagtcggttttaccttgaaattattaaaaattttatatcgttacgatattagttacgaacatatgccttctggaattgatgatttaacaattattttcaaccagaatcaaataacggatgaaattttacccagtttgttatccgatattcgggaagaattgcacactgaccggttagaatggattgatgattatgcaatcttaatggtggttggagagggaatgcgtgacaaggtcggcgttgtagatcgaattgtgaatgctctagcacgaaaacaaattggaattcagatgattaaccaaggggcttctagaatctcaacgatgctcggagttcatcaaaaccaagtaaatcaagctgttcgtgaaatttacagagaattttttaaaaacaaaggtaggcagaccgatgattaaattattacgagtacacggatcagaaaactcatttatattacttgatcaagaacaactcgaaataccaatgaatccagaccagttaattcaattagcaattcaagttgctaataatcaaacagggttgttaggtggggctgacggacttcttgtagtcagttcaagtgaccatgctggcgtccggggacgaatgcaggttattaataacgacggtagcttcgctagcatgtgtggaaatgggctgcgaacggtggctcgttatttagccgaaaaatatgaagaaaatgattttttggtccaaacagatcaagccgatttgcacgtaggacgggtagcaacgattggaaatgggttacccacatatcaggtggaaatttcaccggttagttttaatgctaaaaatctaccaatgcaaattgaaaatcaggataaattgtttaatgcgccagttcgagattttgatgatcagcttcttttttcagccgtggcggtacctaatccgcatttaatagcaattgataataataaccggctttcaactaaaaagttagcggaattgggtcataggttaaatgcttccaatccttggtttccaaagggagttaacgtgagctttggacgggtcattggtcagaatcaattgttcgtccaaacttatgaacggggggttggttttactaatgcctgtgggacagggatgtcagcgacaagtttagtttggagcttgttaaatgatggtcaaactagattgggtgaagtaaatgatatctttaatccaggtgggatggtcaagactcgggtaaatcaaattcatggtgcatatacgattgatttaattgggaatgcgacttttacccaccaaatctggattgatgaggatcagttgcgacaaaataatttggaacaggttcaaattgaatcaaccggggaagaattacattaccaagagtttattcgacaactacctcgctatcgcttttagtgaaataactactatataatataaagattttcagttaacctaattttcagtaaaactgaaacctaagcagattaatttaggactctttggcttttttacactctgatataatagtcatcgactaatgaattataaggagaatgttttgaactggaaaaaaggaactttaggcgcgagcggaatgctcgtcctcgttattttaatcggattgatgttacgaacaccaattaccacgctacctctgatgctaggagatttggctaacaaactggaggtctcgaagagtagtttgggaatcttaacgactttgccactcataatgtttatgttattttcgagtgtcgcctcgaccattttaaaaaagtggggttttaaaaagtcactcctaggtaccttagccatcctattagtgggttcattattacgactcatcgttacaatgccgacgatgatcatcggaaccagtttgattggaatgggaattgcttatttaaacgtttatatgccatcatttgttacagcatatttccctagcaatattggactttatacctcggtttataccttttcgatgatgtttggagtggcacttttcaacgttatcacggcgcccatcatggtgtgggctgggtggtggagcatgctgatagtattagcgattacccctctgttggcattaataatctggttgtttttgatgcctcatctatcagaagaaatccatgagccgcaagttgaagttaaaaaagaagctatgtccaacgatcaaatctgggtgaataaaaaagcatgggcttttctaatcatgtttgggagccaatcgattctaaattacacattcactgcatggatgccatccttgatggcgtaccaccaagtcggatcaggcgtaattggaattatcatggcggctttttcgttgattggcttgccgattaccgtgcttttgccccaattattagttaagtggggacggttgggcaagttgttcttagtaggatctgctggagtgaccggcttaattgcctcaggaatgttatttttccaaaacacttcgtccacaatattttggatgattgaaagtttgctattaggttatgcgattggccttttcttcatgttcgtagtaaccatgtttgtgattaagaccagtaatccttatcgtacggctcagctttcagggatggcccaagcgggtggttatttcattgccgctctgggaccagtgacttatggctgggcctttggtctgaacccaaccggaaatctacaaaatgtagcctttgtggtggccattaccttagcaaccatcatgggagtaatcattgttaaaaccaagaaaatttaaagaaaacctccgaatttcgttttgaagttcggaggtttttatttttgggtacgaattacataagaatccaataatacacgagatataacttgtagggggagcctagagtgaacttcaaaggctggaaaataagttgtttcggatttgaaaccacataattcaattgtagagtatttaccgattgtactatcagcattagtagttattaatataatgggaattttattttttgatgttttctttgcagcttcgattaattcaggggtttcaccgtttagagaaataataataaccaaattgccaggtctaatatctgctgataaagtgcggataatatttggatcatcacttagttggcaatttttattcaagagttgcagttttactaataattcttttgcaattaattcagaaaaaccacgggcaaaaatgtaaatggttttggcatgcttgattctttgcacagactgttcaatatctggaatattaatcattttgatggtgttagtaacttcatgttcgttttttaggatggcacttttaatatcactatcggcacgctctaaattggtaaaatcctttgaactattattctttgctactccatgcttaaaatcactgaaacctgtaaaacctttttttcttagcgcacggataatagtggccgtagaaacgttagctcgttcactcaactcaacaatagataaaaaaggaaccaattctaggttgtcttgaatgaatttccatacaaattgttctgtcgaactcaaattatcatttgccaaaccaatccctccgattgtaaattctttttcaacaataacataaataacaaagtttttgaaaacatttacatcatggatgaggctagaattaggagtataagaaagaggtgcttgaaatgatttatacgtgcacattaaatccagcaattgatttatttattgaaacacaacagttgaaaccaagagtggttaatcggacgaataactatgatattcaggctaatggaaaaggagtgaatgtttcatttattttaaaaatgttaggaattgataatacagcgcttggtgtgggcggcggtttcacgaattctttcattgaggatactttaacaaagaggggaatccccaataaatttattcataccgaccagcctactagaattaacgtttttacaagagtcatagaggaggacacggaatataaagaagtaaatagtggcccccatgttacgaagcaacaagttgccgaactgatgaggatgattgagaagctgacaagtaaagatatattaataatttcgggtagcttttctgaaggtatcaatcctaatattttagttgagattgcaaagttatctaaagttaaaagattcaaattaattattgatacgaattataaagaagttttagatacgttagcatttggtccggaattacttaagccaaatgtcgaagaattagaaaaatggtttggctcgaaaatattgagtcagcaagacttaatcaaatattgtgaaaaattaatagattgtggagcaaaaaatatcctgttatcaatgggaagcgaaggggccttattcgttaataaagatacagttttacgtggagatgcgcctaagggagtagtagtgaatacagcatgttctggtgacactatgctaggaactttcgtagcaggaatgtgccaacaaaagagcttagcagaaaatttgaaatttagtatcgctgctggaagctcaactgcatttaaagcaggattaactgatttttcagacgttgaggagttaaacgaacaaattaagattgaaactgttaggagggatagtaaatgacaaaatatacaattattgcagctactggctgtccaactggaattgcccacacctatatggcccaagaggcgttagaagaggccgccaagaaacgaggagtttcaattaaagtagaaacacatggacaaagcggtacagaaaatcaatttacgcctgaagaaattagcaacgctaaaggagtcattatagcagctgataaagacgttgatattgaaagatttgatggaaaaagattaattaatgtttcagtaactaaaggaatgaaagaaccggatgaattagttagtaagatattggacgatgatgtgccgatataccacagtaatggccaatataataaagaagatcaaatcagtacaactaatggaactttctggcacagtatctatgtagacttaatgaacggtgtttcgcatatgcttcctttggttgttgctggaggggtattaacagctatttcctttttctggggtatcaattctgccgacccgaatagcgctcaatttaattcatttgctcaactgctaaacacgattggcggatttgcaatgaatttgatggtacccgttttatgtgcctatattgctgaagcaattggaaaaagatctggtttagtagttggttttgcaacgggaatgattgcttataccaatggtactggattcttaggaggaattgtcggaggatttcttgcaggatacacagtggttttattacagcatttatttaaaaaattgcctaaatctttagatggtttaaaacaaatttttctatttccggttattggaatttttatttccggtgcgattatgtggtatatgtcggtaccgatgaaagatattaataccggcatgatggcgtttttaaaaggaatggaaaattctagtccattagttttgggattaattattggaattatgtgtgcttctgatatgggtggtccaatcaataaagctgcatacctaactggtacagctttgcttgcacaaggaaattactttttcatggctggagtatctgcggcctgcatagctccgccattagctacaggcttttcagtactttttaaccgtaaagcatactctgaaaatgagcgaagtgctggttatgttaacttcttattaggatcaacgcatattacggaaggagcaataccttttgcggctaaaaatccgttaattaatattccaatttttatggttggatcttccatcgcagcaattttaacttatacaactagaattagcgttccagcaccacatggtggttttatcgttctacctttggttaataaaccatttttatgggttttgtttattgtaattggagcaattgtttcggggctattactttcattagctgatggtcataaagctcacgttggagaaaaaacattagaagataaaagagaagtatcaaatgagcgtaaagtgaatgacgaaagtttagatagtatcctcactgtagataatattaaagttaatgttgatgttgaatctagagatgaactattacggtatctatcaaacttatctgtaagtaacggatatagttcagatgcaaatgcggtatacaataaatatttagcacgtgagtcagcaggatctaccgggatggaaaaaggcatcgctattccacatgctcaagataatacaattaatacgtctgcaatgttagtgctgaaattaaaacaaccgattgaatggaaaacttttgataaccaacccgttgatacggtaatttcgtttttaattcctgaacgtgaccaaggtaatcatttacgatatctttcatcggtttctaagttactaatgcatgaaagttttgttcaagaactaaaaaatgctaaatcggtcgaagaaatagcggcactattcaaaaaataaaaattaaggctacttcagtttaaaatgaaagcgtttgacaaagtggtaccaaccagttaaaataggttttgttgaatggtaccaaccagtacagatgagaagggaagtatttcaaatggaaaatggtaaattacgtggaattaaagcattgtcagataaaaatggtgtgattagcgcccttgcaatcgaccaacgaggatcgttgaaaaaaatgattggcgcagccagtggacatgaagctactcaaaaagaaatcgaagattttaaagtggcgatttcttcagaattaaccccatacgctagtgggatcctattagacccagaatatggaataccagcagcccgagttcgtgatgaaaatgcaggtttattggttgcttatgaaaagacaggttacgatgcaaccgaacctggacgttttccagacattttggatcaatggtcagttcgaaaattaaaagaattgggtgcggatgcggttaaattccttctatattatgatgttgatgaaggcgatgccgtaaacgaacgtaagcacgcatttatcgaacgtttaggggatgaatgtaaggccgaagacatgccattcttccttgaattggtttcatacgacgctgaaaacgacgatgtgaagggcaaggaatatgctgcggtaaaaccccacaaggtaattgaaatgacgaaagaattttcaaaacctgaatatggagtggatgtactgaagctggaagttccagttaaccaagcttacgttgaaggtttcgctgaaaacgatgatgatgtagtttatagtaaggaagaagcagctaagttctacaaggaacaaagtgatgcaaccaatctaccatttatcttcctcagtgctggggtttcagctgaactattccaagaagaattgaaatttgcccacgaagcaggttcaaaattcaatggagtcctttgcggccgagcaacttggcgtaacgccatcgaaccatttgcgggagagagcgaagcagttggccgtcaatggcttcaaacccaaggtaaaaagaacattgaagatttaaatgaggttttagcggttacagcaacttcagttgaagaaaaattgtcaaaaatgatgtaaataaaaaggatgcttcgtagcgaattcgttatgaagcatttttatttttaaatattgaaccctagaccaaaaatacaagttcggttaagtttggtttgtaagcggttttatttatgttatcatctaaggtattaattccaaataaaaaacaaaaaaggatatatataccaatgtataaagaaaaatattttgaagaattgaaaaaggaatttaatagcgaagatgaaattgtaacggaaatcgtcaacttagaagctattttaaatttaccaaaaggtacagaatattttatcagcgatattcacggtgaatacgatggcttaaatcacattttaaaaacgggtgcggggattatccgagaaaagatcaacgattgttttccagaaatgaatgagacagagaaaaacgaattgaattttacggtagcttatccgaagtatgctttagaaaaaaggcaactggaacaagatgcagaagaactaacgcagtggtattttgggatgattacgcgcatgattgggctcactcaattctgtgctagtaagtattctcgttcaaaagtacggaaaagtttaccacccaagtatgcgtatattattgaagaacttttatatgtagaaggtagtccaaaaaacaagcaaaagtattatgaacagattattagtaaaataatcgagctagaccgagcccaagatttgattcagagtttggctggaacgattcaaaaaatggtgattgatcatattcacattgtgggggacgtctttgatcgaggccgcaaatccaaccaagtgttagagcttttagagcacgcccactcgttagattttcaatggggaaatcacgatgtgctctggctcggaggctatgcaggatcacaagcttgcattgccacgttatttagaattgccacgcgctacggttatatttatgatttggaacgggaatatggtattaatttgcgagcattatttactttcgccacgcaacattatcaagctaaccccgccttttatccaaaggcgggtgactttgaccaaaacaacttggatttattgtcccaagttcatcaggcgctaaccattatccaatttaagttagaaggacaagttattaaacgacaacctgaatttcaaatggatgatcggctctttttagatgaagttcagcaaggaaaaattcagttgggagatcaggaatatccgctagaaaatgggtgtttccaaatggttgatgcggatcatccttatgaactcactaaggaagaacaagaagtcattgacagtttgagttactcctttagacattcacctaaaatcaaggtgcatgtgaacttcattttagaaaaagggagcatgtatttaatttacaataataatttgttgtaccatggctgtattcctctaacggaagatggtgattttgatcaatttgaatatcatggtcaaaaatatgctggaaaagatttattaacctttttcgagcgtcacattcgagctggagcagccaagaaaacgagtgatgaagatgatgataccgatttaatgtggtattgctggattggaaaaaaatcgcccctctttggtagaacggcgatgaccacttttgaacgttattttattgctgattcggcgacccacaaggaaggcgacaacccctattttaaattaagagatcgcctttccactgcgcattatattttacgaaaatttggattagatgaacgtaatagttacattattaatgggcacactccagtcaaagtcagcgaaggagaatcgccgatcaaaggtggaggtcaaattatcgtaatcgatggtggactatccaaagcttatcaaaaatcgactgggattgcgggatatacattaattaataactcgtacgggttccagattgtaacgcacatgccattccaaggtattgatgacttgtatgaatcgcaaacgcaatcgactagtttgaaacgaattattgatcgtgatttaccgcgacgcaacattgccgataccacgattgggaccgaattgaagcgtcaagtcgatgatttaaaatacctcttggaaacagatgaaattagtcattaaattttttgaatcgtaagataatccaagtaatgaaggccaatagaccactaacggcaaccatggaccaaaagccaacgctcgtgtgtcgaccgggcaagccgccggtgttcatgccccagaggcccgcgataagggaaggtacggaaataataagcgctgctgaatcaagatatttcattaaatgattcaaatggttactcataatatcggaaaaaagaccgctgattgcgtcaatcaaatcacgataaacttcaactagtttagtgatctgacgttcggcggtttttatattataaatcactgtttcatcttggaggttattggaaaattcatccagtttgaaaaggtgttctaaagcctgatgttgcgtctctaaggtatgttccaaaagaacggtatccttcttaacatttttaagctgaattaattcttgattctgggtagtttgggttgattgctgttcgagatactctaattgaagtttgatatgggacaatttagttcgatagttatcataaatatgcaatagaaaatgggcgataattgcttcagtcgaactaggttggatagcctgggttaggtgatggagttcagcttccgtattagagttttcccgaacaaaaaaattcagttgatgaggactcgaaacaataattaaagggtctaagacaatttcgtagtcagatttttgattggtcatcactaaattacagagacccacaaagtaggtgattttaccgctttcatccttaatcgtggaagtatgtgggaaaacctccggggtcttgattccagctgcaatgttggatggaaaacggttcttttcaattagattttgaagatcattaaagtctttgaatttggtaatttcgaattgattcgaattagttgacatatagagctaatccctctttcgtaaaacggttacatcattgaagcatattactttataaagcaattctattcgattagaatttgaattacaaaagaaagggagtgaattaatgagtaaaccagatttaaaggatccacgaaagttgtatcatacagaagaatttccaaaacaacaacaagatacaccagcattacagagtgagatgcgacctaaaccagactgtggtgaagaaacttacgaaggtcacgggctattgctagatcgtaaagcgttagtaaccggtggtgattcaggaatcggtcgagcggctgcaattgccttcgctcgcgaaggagcagacgttgccatccagtatttccctggagaagattcagatgcgaaggaagtcgcggaatacatcgaaaaagcgggccggaaggcagttttattgccatacgatttccgagacgaaaaggcccctcaagaagtggttgatcgcgtggttgaagagttgggcggtttagacacgatggtgttgaatgccggccaacaaattgcccataaaaagattgatgacctccccgtgcaacaaattagagacagtttcgaagtgaacgtggtggcaatgttggccctagtgaaggcggctaaaccacacattccagcgggaggcgccatcgttactacgacttcggtccaagcctttaatccaagtagccaattgttggactatgcggcaacgaaggcagcaatcgctaattttaccatcaacttagctcagcagttaatcgaagacggaattcgggtaaatggtgttgcaccaggcccaatttggacaccaattcagttagatcacggacagccggaggaagctatcccagaatttggacaaaaatcattaatgggtcgggcaggtcaaccggctgaactagctccaacgtatgtcttattggcttctaacttagcaagctatactactgcccaaatatatggtgttactggtggagaacacatcaacttataaggggaaagccatatgccatggacgaaaaaagattatccagagtcgatgaaaaacttgtcagaaaccgtgcggaataaagcaattgaaattgctaacgcacttttagatgaaggctatgatgaagaccgtgcgattccaattgggatcagtcaggccgaaaaatgggctgaaaatcacgataaatagcaaataaaaaagagctgtaatcaagcggacgtgggagtcgataattcgacgagcgacctttggttatagctcttttaaattagtaactggtatttgaagtgttagtttgagaatcggtgccactgatactaaagttgtaatatgcctgagtattattagtggtacctgcatcgttagtgctgtcagatgcatcggtacttgtctgggcgttagcattagcttgggcttcagcggcagcttcagcttctgactcggatttagcttcggcttcagaagatgctttagctgcactagaagattcagattcagccttggaagcagccttggaagctgattcagatgcagcccgggaagattcagcggccgctctttcggccactgcaatagcttctgcccgtgcagcggcttccgcagccgctttggcggccttagcagcttgtttatcttccttattaatgaccgtcttcaagctaattaacttagtttgttgatcaactgttttctgtgatttttggtttttactcatgtccttaatcaatttttctactgtagtcacgtcaacggaaagattgtttttacgagctttcataataactttatagcgtttgctaagtttatccgccataacgacaatcttgcggacgtcttttaactgtttagtatagttagttctaaattgagcgggtacctttttttgctttaagtttttcaactgatggtcaacctttttagttgtcacgtttaaagcaacgcgagtatgtttattgaaaagatgactgtaatcagcgcgaatatcataagcattttgtgcagctacttgtttggcacgcaaggaatcgatgttcttataatgttttaaactgtcaacatcagacttgagcttatctagcttagtttgagttaccgaatcttttagatcagcgtgacgattatcagtatataactgaccaatttcttcatttaaacgggcggctcggtgggatgaactaaaatgtgaaatccctcgataaatgccaaagattaataagaaagcgacaattaaaccagcgacccaggtgcttaaacgtttaatacttcttctgcgagcacgacgtttgcgacttcgacttcccaaatagagttcgtcatcgacaaaaggctgatggtcctcttgttgcggatggaatcgctccttaagttgttcgatccattttagtactgtattcttcataaacaaaaatcccccagagactagttacttaataactcataatatatgtataattatagtttattatactggttttgggttagatttggatgaaatttattctataaacgccataaatcgtacgcagggtccattaatagttttttagcagctttagtagaaataactgggccatctaatagaatctcgctggcgatggtaaataggtgagcagctaggtcaatcaaggtttcatcaattggtaatagttcgggatgttccttagtttgaattcggcgatcaatctggcaagacacttcatttttaggtttaagaacggtcataccgaagatatcagcaaatccctgcattagatcataagttaattctgaaatatgttgtgctttagttaatttattgcaaatcatagattcagtaaatggaacgtgaacctgaaggcttttcttaccgtcgtcaaaattaagaaaggaaaagcgactatcttcgggatctgcatagagatctcttagtcgatgtgcaaacacccaatcggcagaaccacgggttgttccgttcaaagggaccacatgaaaagtgccaaaaacaatggggcgtgcttgcgtgatattgagatgatcggtcatcgtgcgaataaaaatatcccgacaaggttgggagcgtaaaaaatctcggattaattttctagtagactgatctgtagtatggggcgggcgttctgtatcaataatgagcgtctctccaggaatgttccacgcgctaatatcatgaagatacaccgttgtatcaccacaaatcttagcgtttttaatcagcggtaagttccaattttgtggattacgatcagtaaaaatttgctttgagctgagctgctggaattcatcgtagtagttcagttttagttccatccgaatataatgtcctcctgagaatgattatttgtaaaaaaattaatacgtaaaatagtaccagagagaagtatcgttaacaagtatgattttgcaggtgacatttaataaaagcgtcttctttgtggactctataacgtttgttttaaataaaaaatattttttagaccgattgaaaatgatatggatttattatctaaaaatcgctactaagatagcaaaaatgaaatctataccactttacacgcacggtatcgatagtgctggctataagaatagttgaagtgggtgacaggctaaaagttcatttggcttggaaagcggtgttagaatgggcgtgagatgatatagaaaagtgaatgaaggtgttgtaaatggatatgaatgacctagaaggactcggtcggctagtaatcgcagcaatttgcggggcgtttatcggttatgaacgttcggccagattaaaaaacgccgggattcgaacgcatattatcgtggcgctgggggcggcgttaaccatgctaatttcaaaatatgggttttatgatttgttgcaaagtcgcggcatcggactggatccctcacgaattgcggcgcaaattattagtggaattagtttcattggcgctggaacaatcttggtgcgtggtgaaggagtgaacggattgaccactgctgcgggagtctgggcgacggcggccgtaggaatggcgattggttcaggtttgtattttatcggtttcacggctgctgttttgattgtggcttcacagtatctctttcgcgataacatcatgttgaaatacttgctgaagcgcaagcattttcattgccaaatcatcatgaaaaatgactcgacttcactgaagaccattcaaaaaatgttcaatgaggggggctttagaaaaaatactttttcgattagtaatatcaatgacaatcggattacagtcgagttggaaggggtcttatcagctgaaaataatattgactcagtattaatgcggatagctgaaaatacggcggtggttgaggtccggcgagaagattgaaaataaatataaatgaaaagatttcagcgaaggtgagttatttaccctgctgaaatcttttttaatttatttcattttccgatttaaaatcgccgcaacagtttgttgatagtgagctttataagttttattttgcaatagcatggttgaaaggatatcgatgatataaaccacacccagttgggagttgataaattgagtattatcaacaaattcgctgtattgaacggacaattggtaatcactcatttcggctaagggactatcatcaaaagcagtgatggagacgatctttagctggtgttgtttagcaacagcaacggcttcattgacttcgttcgatttgccagaaacagatagaacgattaggaggtcatctttttgcataatgctactactgatatacatggtgtgactatcagaaggagcgaaagcattaatccccatccgcattagccgttgagataattcttgcgcattgtaacccgagctacctaaaccaaaaataaagacgcggggagcatttttaataagcatcgccacttgatttaaagttttttgattgatacgtttccaagttccagtaatcatttgattgtaaaaatctgtgacctgatctggaagaggtgcattatcaacattttcggtaatatttgaagttgcttcagccaaacctaacttaaattgactgaagtcgggatatcccatctttttaacaaagcgcgttacggtggcggtactaacttcggcctttttcgataaagtattgatattcatctttttgacatcagcgggatgctggatgacttttagagcgattttgcgttcttgacgcgataaagatgggtatttttgctccacaacgtcaatgatgttcataaaaaatcctcctagattaggtttgattagtgttaattatacgctgaaaataaaaaagactggaacttttttcaagtattccagtctttaatacaagggtcctatttaatggcctcaataaaacgagtggcaatttccaagggacgagtaatcgcgccaccaacaacgaccgcgtggcagcctaattctaaacaacgttttagtttttcgggagtatcaatttttccttcagcgataattggtcgcgtaacttgggaacgtaattctttcaaatattcaaaatcatgatcagcaatattcataccttgggtggccggcgtgtaaccacgcatcgtggtcccaatcatatcaaatcccaagcggtctgcctcaagtgcattttcaatggtatcagtgtcagccatcaataatgtattaggaaattctgtccggaattgttgaacgatttccgcaagtttttcatcatggggtcggcgttgaccagttacttggcaagcgacaacttcgacaccagtagctgccacggcccgcatttcctttaaagtgggggtaataaaaacatcggaatcaggataatctgtttttgcgattccgatcatcggtaatccggcttcatcttgaattgcttgaatatccacaacagagttcgcgcgaataccagccgccccggccattttagctgcccttgccatacgagccataataaaagaactatgcaatggctcattaggcaaagcctgacatgaaataattaacttacctttaaccgcctcaaaaaaattatttttcataatactgacacttctcttttatcaaatttaggtgaaatatagcaatattaaatatgtgatttgaaatagtgatttaatcaaagttagttttgtaatagttaacgtttaattcaatcatcgcagtaaatatacaacgagttaaaaaatattgcaatggtataaaatgataataattttcatttggtgggttaatcatctgcggcagtgattgtaaaaatatttttcactttttttaattgtgaaaaataaaaacaaatgttaatatgaaagcgctattaacgatgcgccatagaacggaggaattcggaatggaaagaaattatcttgcattcgatgtcggtggaacgactattaagtatagtgtgattaatgaggatttggaaacattacgatatggcaagtttgacactaaaaagaatatcgacaatcatatcttaaaaactttggaagaagtaaccatgtcgatacaaaaggaaatagaattatgtgggattggagttagtacggcaggaatagttggtaaagacggcagtattcaatatgctggaccaacgattccaaattatattaatacgccaataaaatccgctctatcaagccgaagtaaaacaccagttagtgtaatcaatgatgttgatgccgcattattaggtgaagtttatgctagaaatttagatcaggaggacgtctattgtattgcattgggaaccggaattggaggtgcgcattaccgtcatggagaattgataggtggagcacatggtaagagtaactcaattggttattccttgtttgatattaaaacagggacaaattatgaacagcgagcatcaacgctaactttggaagctcgccttgcggaatataatactacggtggttgaagctttcgaaaaagcaaaacaaaatcaaatgccatttattgacattattaaggcttgggtaaaggaagtagcaagaggtttagctgaaatcattgtactatttgatccaaattacattgttattggaggtgctgtttctgctcagggagattaccttttaggtcttttgaatgagacactaacaaatttattaccacttaatttcaaccaggctaaattaagtacggctaaacagggaaataatgcccagttgattggggcaattgtacctttattgaataataaagcttagagggggaaattactatgcaagtatcaattaatacagcagtttttttaaatcaaattcaacaaggtgctagtcaataccaatgtttgaaacaattagttggagaacctttagcaaatgttgaagttcgcggagaattatttcaaggcgacactcgtgaggttgaactagataaaattgatcaattatgtcaaaaacaaagttgggacttttatttttcaattccagaagaattatttactaatggcaaacttaaccaaactatttttgattacttaaaactttctgaacggcatcacattcgaggtttaaagattggcttaggttcatttgaaaatctagacgaaaattctttaatgaagttgcgaactgctttgcgagacagtgaagtaaaagtaaccgttgaaaatcaacccaatattaatggaactattaatgtatttaaaaataatttgataactttgttaaacaaagtaccagaactaggatacacatttgattcaggaaattggtactgggtgaatgaacgtcctgaagaagcctttttagctttaaaaaaatacataactgtattccatttaaaagatattagggaaaaagctacggtaatgctagataacggagatacagcgtggaaatcattagtaaaaaatttagatagaacaatacctatttttttagaatatgatatcgttcctgatcagttggaacttgaaatgaaaaaagttaacgacgaaataaatttaaaaaatagtttacatttaaaatgtaatcggttacaatgattttgtaatagttaacgaaattcaattgtcacaaaagttgcatgctactaagagcggtgcaagtttttgtggcattttttatttgcatttgagtatttaaaaatgctgtttaagacgaagcacaatcaattacatttcgtagaatacggaggcttctagatggttaaacaaggttttggagctttaaattggctagttttgattgcatatttaattattatgttgctaatcggactgagttttagtaagaagagttccaaaaattcagaagaattttttaaagctagtactagtaatgtgccagcttgggcagttgggttcagtatttttgccacaacattgagcgcaatcacttatatgtccactccagaaaaatcatttttgactaattgggcatatgattttggaaatttagcaatttttctaattactccaattttaattaagtactacatacctttcttttctaaattaaaggttacaacggcctatgaatacttagaatttcgattcaaccctttcttacgtgtatttagcagcattttgttcattttatttcatataggtcgaatcgcgattgtgatttatttaccaactgtagctttgcagtcaattattaacattaacccttatttaatcgcatccttaattacaattctttgtattatttacacctatcatggtgggatggaaggtgtaatttggagtgatgttattcaagggattttactcttagttggtgcagtattaataattttctttgccgtacatggtacacatggcggttttgctactgtagcaaatgatattgcaaataaaggtaaaattctgactaaagctgactttgtttggagtgtaactaagtcaactgtaccaatcattcttttgggacaaatttttaatactttgtatcaatacactgccagtcaagatgtggttcaacgttataccacatcaacggataacaagcatattgctaaatcaatttggactaacgcattactttctttaataacaatccctcttttttacggtatgggaactgtaatctatagtttttatacacatggaggaagcttaccgcagggatttaatacgtcggctttagtgccttactttgttctaacagaaattccagccggaatagctggcttaatcattgctgcaatttttgctgcctcccaagcaaccattgcatctagtttaaatagtaccgctgcttgtctagtgacagatattcagaaaagatttatgaaagataagagcgatgcaatgagtatgaaattgacccgtttaagtattttaatttgtggctttttaggcctactagttacattagtgcttattaaactccacagttccgatatgatcgataattatttatcactctttgggttatttggggtaccgattgctggaatctttgctttggggattttaagtcagcgtgctaatggatttggagctacggtaggaatgattgttacaacagttatttgttatttcatccaaacacatggtgttaatgctctatttgtgagtgtggtcggatttttgggagcgatgattttagggtatatatttagcttgttaaaacctggtcacaaacaagacattactggcctgacattcaggacaattaataaagatgtcaaaattaaagtgaaagattgattaattaaatttgtttataacttttaaaaaattttatttgaaggagaactatataatgattagagatttagaaaaatacaaaggtattatccccgcattttatgcttgttatgatgatgaaggaaatattagtccagaacgggttcaaaaattagctaagtattatttagaaaaaggggttaaggggctctatgtaggaggttcatcaggcgaatgtatctatcaaacagttgcggaacgcaaactagttttagaaaatgtgatggaagctgtgggtggtaagatgactattattgctcatgttgccgctccttcaacgcgtgacagcatcgagttagcaaagcatgctgaaagtattggagtggatgcccttgctgcaatcccaccaatttactttggattacctgaacacgcaattgaagcatattggacaagcatgatggaagtaactaatttagatttcattatatataatattccgcaaacaaccggttatgcactatcagaaaacttatttaaacgtatgatggcaaaagaacaagttattggggttaagaattcatctatgccagtaatggatatcaatatgtggaaattacgtgctggtaaagacaatattgttttcaacgggccagatgaacaatttgtaggtggacgcgtaatgggggccgatgcaggtataggtggaacttacggtgtttatccagaattgttaatggaagcggatcggtgcgttcgtgaaggtgaacttgaaaaagctcttcaaattcaacttaaaattaatgatttaatttcagaattgacatcatttaaaggtaatttatatgatgtgatgaagttaatcttagctaaacgtggggtaagtgtaggacgagcacgtaatcctttaccacatgtagaagatgatgaaatggatcatgttgaggtagtacggcaacatattgatgatgcaattgctgaatttactaaataataaaaaaacgccgagtctccttaaaagaggctcagcgtttttttaaatctgtgaccagacgtccgctcccaaagtagggaagaggggtacgatgcggcctagttgttcagctgtatattggaactcaattgctggtaataaaacgttaattgcatcggcagcatgttcactaacttcagctgctcccacaagatgatggtcttgatcgtaaatcaaggtgttatcaccaattgtttccttatcaacttggcggaaccatccgtcaggaagatgattagttttaatggtgtaatcaggattttgctgagcttcttcgacgctaataccaacctgtgcgatttgtggtgaggtaaagacaatggttgggatggccggatagttgattgcgtcagtagtctttcctgtgaaaagttgggttaaataactagattcaaagatcgcagtcggggtgagcttaggctgttctttatcaagcacatcaccagaagcatagatgttatcaatgttagtttggagatgatcgttaacttcgatcccgttagcattgtaactaacgcctacttcgtctagtccgatgttttcgatgttaggaattcgtccggtagcatccaaaatccagtcggtggtgagggtttcgtgatcgttataagacacggtaaaatgagaaccgtcttcctcaaaacggttcacctgagcgttgtaaatgaacttcacccctcgtttttcgaggtcggcaatgacttgttttacgtaatcttgattaaacttgcgcaacgcccgattatggcgtaaaagtacagtgacgttcgcgccggcagcattggcaatcgtggcaaattccatgccaatatagcccgcgccaataattacgatattttcaggaagatgcttgaggttcataaaatcagtactgtcatgcgtaagttctgatcccataacatctagatggtggggacgtagccccgttgcaatcacgattttgtcagcggtgtagcgctgttgatccacttcgatggtgtgagcatcaacaaattttccacgaccgtgaataatttcgacgtcaacagagtcgagtagaccagtaatcatgtccggcaagccgtcgatgacttcgtgttcatgttctacattggcagtccaatccagttttaagtcaccatttacaatgccatcaaggcgttcttggtggcgtaaaagttgaaccgggttgtccagcgtaattttcgcgttgcatccacggtttggacaagttcccccgattttgtccgcttcgacgatggcgacttttttaccactattagctagtggaaccgccccgtcgaaggcaccatgccccgcgcctaagtacaaaacatcaaattgataactttcagtcatttaattacctccatcctaaatttaggtgaataaacaattaccattgttggcacgagcatagcagaggataggggcgagttgcaagcgattgcaactgaagagtacaaaaaagcaatccttaactttaaatagggattgctaaaaaatatcttactaacgttttaatgatttaatcgatagcattgaaataccaccaatcaaggaaaaaataaatgagacaataaaaattccagaataaccaaagagacttatgacggcagcggctagaaccggtgcaatagcttgtgtaattgtattacctaagttgtaaacacctaagaaaaatgcaacacgattttgatcagggataacttttaagtttaataaattatcaagtgcgttccataagcccattcctaaaccagcagctagggcgtgaagaataataccagtattatttcttaagaagaacagggagagagctgcaattgctaataagatagttgagagacctactggtaatttcagtactttaaatttatcagatagtggtccagcgactaatcccatcaaaatgccaaaaataagcataatcatgttaataagttggatagaagattgagtttgattaccacgatgaagaaagtcgatcattatatataaaatgtatcctgtaattgcaaagtttccaactccctgaaacatttttcctataagagctaggtagtagtcgcggccgatttgccaagaaggaaaaattaactttacattttttaaagaaaacttttctttctttttagttgaggtttcatctaaattagaaggctcatggacaatcaaagttgcaattaatacaccaacaaatgtgaatataccaaagactataaatcctagtcgaaactggctaaggaataaagcaccgataacgttaaatccgttattacctaaagccatgcctagaccaccataagcagaagaagcggtacaccctttccatcttcaggtgcaaagtcaatccaagcaaccatcggcgcaacaatgaaattaagtgcagcttgaccaatcatccaggtgattagtaagaaagagatattagaggcaagtgatgcaccaatcatgcttaacatgaaaataaaagaaccaccaataatccaaggagcacgtttcccatatttagatttagttttgtctgagaaggcccctgcaatcatgttagaaatggttctgttgcaaagttttaaatctactattagataaggtagaataatagaaaaagatagcaggaggaatgacgatgagtcattttaaaggaaagcaatttcagcaggatgtgattattgtagccgtgggctactatcttcgttataaccttagctatcgtgaagttcaagaaatcttatatgatcgtggccttaacgtttctcatacgacgatttatcgctgggtgcaagaatatggcaaactactctatcaaatttggaaaaagaaaaataaaaaatccttttattcatggaaaatggatgaaacgtacatcaaaattaaaggaaaatggcattatttgtatcgagccatcgatgcagatggtttaaccttggatatttggttacgtaaaaaacgggacacacaagcagcctatgcttttcttaagcggttagtgaagcagtttgatgaaccgaaggttgtagtcacagataaagccccctctattacaagtgcctttaagaaactaaaagaatatggcttttatcaagggacagaacatcgtaccattaaatacctgaataatttgattgaacaagaccatcgtccagtaaagagacgcaataaattctatcgaagtttacgcactgcctctaccacgattaaaggcatggaagctattcgaggattatataagaaaacccgaaaagaaggcactctcttcgggttttcggtctgtactgaaatcaaggtattattgggaatcccggcctaaatcatagataccgtaagggattttattctttatttaaaactttgcaacagaaccttagaaattgcggcaacaatcatcccacaagttgagaaaagcgctactaatgaaactttatttggagcatctagtttttgaattaaagatggtaaaaataaactattcattacgatataaggtcctagccaacttgctggtccgataattaagccgggtactaatcttgttagtggtatagaaatttttttcataattttaatgctccttaattaaaatgattaattactttgtaatatttaaaatcagcgaatgaactatgttgatatgcatcaacagccccaataaaattgaataatcctgtaaatccaccaatttcaccgggttctccgttaacaccttcgtcagataaatacttaacatcaattgaattatccaaatttaaccattgtttatttttcaaatattgaaattggacaattccactcttataaatcagcttaatttcgacgtcacggtttgaaattggaacttcactggaaatgaaatccgtccttgtacctaatttagcttgtagtatacgcaatacaattccttgtccatcatctttttgacaaatgcgggcataaatccaattgtttgagtcataatagagcccaattcctgctgtttgtgagtaatgtacaggattaaaattgagctgggtttgcgcaatatagtctagggatgtagctcgtgtagccatgattgaaggatttacttgtgaaaagaatgaattccgaccgtatattcttaggtagccaggatgttcagtagtattaacccagctatcatcttgagtgtggtaaggagtcataaagctaatttcctcagacttttgagcaaaatcaatatttatatcaaaactgtgaaaatcttgttttacgggtttttgatttttaacagaaaattgcatttttgccagattactcttatcttccatttctaaccaattcgaagcggtccaatgcattttttgaagagaagtttctctacccaatgggttcaaagttgttgatggtagaggtctagacataagatgagcaataaaccattctccctcgggagtactgactagtgaaccgtggccagccttttgcataattgaatttggattgtacatttcaaaatgaccggaatcgggatctcctaaagaaaacagatgctgaggagaagatgtaataatgggttcgccagttggattagattcataaggtccaaatatatttttagacctcccaatttctacaccgtgagcgtaacctgtaccaccagctgcaattaaaagataataatagccgttgtgtttatatatttgaggagcctcggcacagccacgagtggtaaatcctgaagttacgcgttgccaatcgcttaaaagatgaccattttctagattgacttcggcgataacaatatgaccgggggcctgataaccaacacgtgtttcccactctaaaatagaaatatagtgttttccatctttatcatggaaaatagaaggatcgaaacctattgaagttatataaataggagtggaccaaggaccaagtatattatctgcagacataatgtatgaatctgagttaaactcacgaccagacatattttgcatgtgggaatatgcaagccagaatttgtgttttttttcatcataagatagatgaggagcccaaatacctgctggtgtgtttgttccaacaagatttacttcatttttagataaagcatgggaaattaatttccaattagctaaatcggttgaatggaatatttgaattgccggagtccaatggaaagtagaagtggctatgtaataatctgcacccacacgaataatagatggatcgggtgccattcccggaattattgggttttggatttgtgtcatgaaaaatacctcgtttaatgtgatttaataatgaataaagcgtttcaatacttagttatgttattatgtaaacggatacaatacaatgggatttaaaaatgatataagaaaaataattttattaagtaagaattgtaacttttgaggggaaactatggaacagcatcacgagaatgtggtttctaatatagatattggaataagattttatgagtcaatagttgataacgatggttatgtccccttccattggcatagtagtattgaattgatttgtgtcttagaggggacactaattttaaaatttgaaggaagaaaacacattattcagcaaaatgaatttgtggtgttttcttcaggtgtagttcatgatgtaacgaatacatctaaccatgctttagtgttacaaataccaatcaaatttatggaaaattactttcctaatgcagatcgattacatttttatacggatcaacaaaaaagaaaaccagaatatcaaataattattaataggctaattgctttaaatagaattaatcaaaaaggagatgagggatatttatttgatatgggcatgattttgcttaatgttttaaagtctttaattttaaactttacagatgaaaaaagcccaattgaaagtaaaatgagtggactgaaagagatactaatatatataaattcgcactataatgaaaaaataagggtggcggagttagctcagcattacggatataatgctagttacttgtcacgcttatttaaagaacaaacagggattacgcttatcgaatatatatatgaagttcgtttgagtaatttatatggtgatttaattgatacagagattcccattggtcaactttttgaaaaacatggtctatttaatcgtagaactacgagagaaatgtgtaaaaaaatgtttggaaggttaccgagaaagattcgtgaagaaagccgcaaataaaatggtgacatcgataaaacatgtactcttagaaattgtccggatgagtttatcgggtaatcttaaaagttatacctaatatacgataaaatcttggtgaaatgttactatagataggggaagtattttaacagagtaggtatagatatggaaaataaatacgacgttgtaaaacgagatattaaagaaaaaatattatcaggacattattctattaatgataggttgccaaccgaagccagtttaatggaacagtatggcgttagcagatatacaatcagacgagcgattggtgatcttgaaacggatcattacgtttaccgtattcaaggcggtgggatgtttgtggatgattggcaaaaatatataaataaacccattgagggaaaaatgattggggtaatttcaacgcatatagcggattatatttttccaaacattattaccgggattgaccgttacgtttctgctgaaggctattcgattttgattagtaacacccagaatgatccgcagaaagaacgtaaaggaattaaaaaaatgatggaaattggcttatcaggcttgattattgaaccgacacaaagcgctcttggaaatcctaatcgagtcttatacgataagcttaaagagacggaattacccacggtattcattaatgcgcactatcctgagttagatttcccgtacttggaagttaacgattatgaggcggaacgccaagtcaccaacaagttaattgggatgggtcacgaaaagatactgggaatttttaaaattgatgatacacagggtgtccatcgaatgaagggttacattagtgcataccaggaacatcgagatttagtgatgttaagtgaaatggtgatgtaccaatcatctgataacatgcacaatgtatttactcgaatcgaaagcattttagcacgtccagatcggccaacagcgattatctgttatcatgatcaaattgccattcgggtgatagatttagtccgctcgatgggattaaagattccagaagatatttcaatttttgggtttgataattataagttggctaaatatatttctcccaaactaagtacagttgaacatccgaaggaaacaatgggtagagacgctgccaagacgatttttgatatcatcgaaggtcgcccctatgaaaagaacaaagtttatgatccagaattaatcattagggaatcaattaaaaagatataagggtttaagtttttaaaacttaaactcttattttttattctaaaaattcatcctaacaaattttaaaaaatgcattgacttgtccgtataaatattcgatgattaatatcgaacttatgaatacgctttcaaaatatgaatgtgtgatttcaaggaggaaaacaatgagtacggaaaagaagattccaagtggatttatttatttctttggttcatttggtggaattttatttggttatgatattggtgtaatgacaggagcacttcctttcttacaaactgattggaacttgcaaaataatgcgggggtaattggttggattacatctgccgtaatgtttggggccatttttggtggcgctttagccggaaatttgtctgacaaacttggtcgtcggaagatgattttgatttcatcgttagtttttgcgatcggctcacttttgtcagcgctttctccacacgatggacaaatttatttaatcgctgtacgtattttcttaggacttgcagtaggtgctgcatcggcccttgtaccggcttatatgtcagaaatggctccagctcgtttaagaggtcgtctatcaggtattaaccaaaccatgattgtttcaggaatgttgctatcatatattgttgactttttacttaaagatttaccagaacaaatggcttggcgtttaatgcttggtttagccgctgtaccagcagttatcctttatttcggagttttgaaattaccagaatcaccacgtttcctagttaaaagtaatgatattgacggagcaagaagaacattatcttacatccgtcctgaaaatgaagttgatgcagaattaaaaacaatcagagaaacagcagctgaagaagaatcagctaatactagctcaacattcttagatttattaagtggtaaataccgttacttagtaatcgctggtgttggggtagccgccttccaacaattccaaggtgcaaatgccatcttctattatattccattaattgttgaaaaagcaactggaaatgctgcaagttcagcattgatgtggcctattatccaaggtgtcattttggttcttggttcactagtattcctatggattgctgacaaatttaaacgtcggacattgttaaccatgggtggaacggttatgggactttcatttatccttcccgctgttcttaacatgttcatcaaagatatgaacccaatgatgatcgttgtattcctatgtatctacgtagccttctattcatttacttgggcaccattaacatgggtgatcgtcggagaaatcttcccactagcaattcgtggtaaagcttccggagttgcatcatcattcaactggattggttcattcttagttggtcttttattcccaatcatgacagctaacatgcctcaagaagcggtgttcgcaatctttggaattatttgtttgttaggtgttctatttatcagaacacgtgtacctgaaacaaaaggtcacacactagaagaaattgaagaacaaggacttggaaaataaattagtttggagattttaaaatgaatttagttgaaatatcaaaagaaattgaaaatggcaatgtatcacttggtattgaacttggttcaacccgaatcaaggctgtcctaatcaccagtgactacaagacaattgcttcaggaagttttgtctgggaaaaccaatttaaggatcaaatctggacgtattcattggatacagtttggcaagggatccaagctagttattcgcagatggctgctgaagtgcatagcaaatatcatcaatcattaacttccattaaatcaatcggaattagtgcaatgatgcatggttatctagcattttcaaaaaataatgatttgttagtgccattccgcacctggcggaacaacatcacagaagaatctgctgcaaaattgacagaggcatttagtttcaacattccacaacgctggacaattgcacatctctaccaagcaattctaaatggcgaagaacatgttaaggatattgatttcgtaacaaccctcgctggttatgtgcactggaaattatctggtgaaaaagtattgggtgtgggtgatgcctcaggagtcttccctatcgatgaaaagacaggctattactcaaaatcaatgctgaaaaagtttgctgaattagaagatgttaagcagtttgattgggatatcaaccaagttctcccagatgtgaagagcgctggtgaaaaagccggtgaattaactgccgaaggtgctagtttacttgatgtaactggaaatcttcaagcgggtagtgtaatggctcccccagaaggtgacgcaggaaccggaatggtgggtactaatagtgttcgcaaacgaactggtaacatttcggtcgggacatcagccttttcaatggtggttctagaaaagcctttgaaatccgttcatcgtgatatcgacgttgtaatgactcccgatggagccccagttgctatggttcacgttaataactgttcatcagatatcaatgcttgggcccaaatctttagtgattttgcagcaagattaggaattaacctagcaccagataagctctatgaagcactcttcttagaagcaactaaagctgatcatgatttgggacatttgattaattatagttatcaatctggtgaaaatattacaaatatcaaagcaggacgaccattatttgttcgtaagtcggatagtaatttcaacctaccaaactttatgcaaactcaactttattctgcgtttgcaccactaaaaattggtatggatatccttagcaatgaagaagatatcaagacggatgtcatgattgctcaaggtggattattccgtactccagtagttgctcaacaagttttatcggatgcgcttaatattccgattactgtaatggctaacgctggcgaaggtggaccatggggaatggcagtcctagcaatgtttgctagcgacagtaatggccaaagcttaagtgattatctagacaccaacgtctttagtaatcctgaaagtatgaccttgagccccgaaccagagggcgttgaagcatatgacgaattcactaaggaatatgtagcaggcttaccagttgaagctcaagctggagaagtaatttaggagggataaggttaatgttagagaagttaaaacaggaagtttacgaagcaaacatgcaacttcctaaattagatttagttacctttacttggggtaacgtttcaggaattgaccgcgaaaaaggtctatttgttatcaaaccatctggagtcgactatgacaagttgaaaccagaagatatggtagtagtaaatttgaagggtgaagttgtggaaggtgaaatgaatccttctagtgacacaccaacgcatacggttttgtataacgaattcccagaaatcggtgggattgtacatacccattctccatgggctgtttcctttgccgctgcagaaattgatgtaccagctttaagtacaacccatgctgatacattctacggcgacgtgccggtaactccggcactcactaaagaagagattgaaggcggttatgaagaaaatactggtaaggtaattgttaaaacattcaaggaacgtaagattgatccagaagcagttccagctgttttggttagccaacatggaccatttgcttggggtaagacacctgacaaagcagtttacaatgcaaaggttttggaagttgcttcagaaattgattaccacgctcttcaaatgactagaagaaatattgaagttcctcaatatttgttagacaaacattattaccgtaagcatggtaagaatgcctactacggtcaagaaaatgctaagtctaaagaacatgcagcaagaaaataaaaaaactaaaaaataaggagatttttatcatgaaaaaagtacaagattatgaattttggtttgttacaggtagtcaattcctatatggcgaagaaacactacgctctgtagaaaaagatgcaaaagaaatcgttgataagttaaacgaatcaaagaaattgccttacccagttaaattcaagctagttgctacaacagctgaaaacattacagaagtaatgaaagaagttaactacaatgataaagttgccggtgtgatcacatggatgcacactttctcaccagctaaaaactggattcgtggtacagaattactccaaaaaccattgctacacttagcaactcaattcttgaaccacattccatatgacacaattgactttgattacatgaatttgaaccaatcagctcatggtgaccgtgaatatgcattcatcaacgctcgtctacgtaagaataacaagattatctcaggttactggggtgatgaaggcattcaaaaacaaattgctaagtggatggatgttgctgttgcatacaacgaatcatacggtatcaaggtcgtaactttcgctgacaagatgcgtaacgttgctgttacagacggtgacaaaatcgaagctcaaatcaagtttggctggacagttgattactggggtgttgcagacctagttgaagaagttaatgccgtttctgacgaagacattgacaagaagtacgaagaaatgaagaatgactacaactttgtagaaggtcaaaactcttctgaaaaattcgaacacaatattaagtatcaaattcgtgaatacttcggtttaaagaagttcatggatgaccgtggatacacagcattcacaactaactttgaagacttagctggtttggaacaattaccaggtttagcagcacaaatgttgatggctgaaggttatggatttgctggcgaaggtgactggaagacagctgctttggaccgcttattgaagattatggctcacaacaagcaaactgtatttatggaagattacacacttgatcttcgtgaaggtcatgaagcaatccttggatcacatatgcttgaagttgacccatcaatcgccagtgacacaccacgtgttgaagtacacccattggacattggcggtaaagaagaccctgctcgttttgtatttacaggtatggaaggtgacgctgttgacgttacaatggctgactatggcgacgaattcaaacttatgtcatatgatgttactggtaacaagactgaaaaagaaacaccatatctaccagttgcaaaacaactttggactccaaaacaaggttggaagcaaggtgctgaaggctggctaacacttggtggtggacaccatacagttctttcatttgcaattgatgctgaacaattacaagaccttagcaacatgtttggtttgacatacgttaacatcaaataatgctttacagtaagatttaaatcttaaaaataatttattcaatgccacgaagtagaaatctttcgtggcatttttggtggttaaaaaattttttgagtatacataattaaagaaacaaatgtttttttaagggagataccttttattttggttaactttgtgcaatactacacatgtaaataattaaattctaaggaagtgtctttatgaaaattgctgtaattaaggagcaaaaagaaggcgaaggacgggtagcagctacacctgaaaatgtacaaaagatggtagaagctggaaatgaagttcttgtggagcgcgatgcaggaattggtgccggattttccaatgaagaatttgaaaatgcaggaggaaaaattgtttctcatgcggaagcttggaaggctaagttgtgtattaaagttaaggagcctgacgaagaagaatatcaatattttgaaaagggtaagattgtttggggcttccagcatttagcctctgcaaaagctaccgtggaagctatgatgcaagcaggagtaacggcaattggtggtgaaacgattgtcaaagatggaaaactagaactgttagcaccaatgagccaaattgcagggcgccgctcagtaatcatgggagcatattatttagaagcgcaacatcaaggcgctggtattttattgtcaggaattccaggtatgatttcagcgggtaatgttgtaatttttggtggcggtaacgccgctaccggtgcagcagatacagcactgggattaggttgctcagtggtaattattgaattgaacgaccagagaattcaacagctccaaaaattatatgaaggtaaaaaagttcgagtcgttaagtcaaatgaagcaaatttagcccaagaaatcaaaaatgctgatctatttatatcgaccattttgattccaggttctcggccacccaagttggttaaagaatcgatggttaaaaagatgaagaagggctcagtcatcgttgatattgcaattgatcaaggcggaacggtagaaaccattgaccatccaacgacgattgacgatccaatttttattaaagatggcgtaattcactatgctgtacctaatcaaccaggagcagttccacggacatccacgatggctttggctgccggtaatttagattatctattggaaatagccgatcaggggattgaagctgctggtaaaaatgatccagcattagcatctgggattaacctgtatgaaggaaaaattactaatcaaggtttggcagactccttgaatcttccatatactgaactgaaactatagaaaaagggggtggcgttgatgttagtagagaaagaacccagaaaccaagttgtagcagtaactgataatttattaaatctaaatcagattgaagaagcccgcgaggttattaaaaaatacgcgcgacggacaccgttagttaagtccatgtttttgagcaacaacgttgtccatggggaggtctatttaaaattagagaatatgcaattaaccggttcttttaaatttagaggggcgaataacaaaattaaccacttgaatgaagaagaaaaacaacgaggtgtaattacagcttcggctggaaatcatgcgcaaggggtagctttgaccggtaagctgctgggaattaaaactacggtagtgatgccggatgaggcgccccaaatgaagcgcgatgcaacccgaggatatggagcggaagtagatattcatggcgcaacttttgatgacgctcacgaatggatgcgagaaagagctgaaaaagaaggaaaaaccattgtagatccgtttaatgatgctttaatttgtgctggacaaggaactattggtttggaaattctagaagatttagtggatgtagagaccgttgtagtaccagtcggaggtggtggtctaatttcaggaatcgccacggccttaaaatcgatcaacccttcgattcatatcgtcggagttcaatcggaaaatgtgcacggcatgaaggcgtctgttgatgcaggcaaaattgttaaacatcaccaagattttacgctagcagatggaactgatgtagcaaccccaggtgatattacatttgggattgtttctaaactagtggatgagattgtcttggttagtgaagaagaaatttcaaaagcgatgaaagatttaatgcagagaaccaaggtggttgctgaaggagcaggggcattgccaacggccgctttagaagcaggtaagattgatccaaagtggactaaaggtaagaaggttgtagctttagtttccggtggaaatgtggatttacagcgagtttcacagattattgatcacttctttactcctgttgatacgcataaaggtgccattgggtaattaatattttgtgtgtgaaagagggaatcaaattggcaaaaaataaggagcaaaaaagcggtaaacatgtaccgtatgtcactaaaaagcaacggggtggtagtccagccatcttaatcatggggattattttagctattatttttggtgcatcaacggcttattcagggatgaaagctggattaacggtcgccgcaggaattccaggttcaattattggatcgggattggttagtatttttgccagaaaaaaagggattttaggcaaaaatatactgcaaggcatgtcaagcggtggtgaagccattgccagtggaatgatttacgttttaccagccattattttaattggcgggcacgttaatttttggaccggaatgatggtgggaattttagccgtgttatttgccattgggagtgcttcgttagtacaaaattatctaattgtagaagaacatggacgtctagcttatcccgaatcaatggcaattacggaagcgttagtggcctcagaaagtggtggtgattcacttaaattcttagggattggtttcggaattggtggtttgattaccgtggttacgacccaagttttcgggtggctaaacaatatgattacttacaccggaaattcattttatcgttggaaaatgtctactgaagtcaatccgatgttagcaggaatcggttttgtagttggaattgatgtagctttaacgatgtttgcgggatcgattctttcaaattttgcggtagttccgttggtaagctactttacccaaatggctggcggaagtgctcatgtttggaataatgcagctttgcatatttcacaaatgggtgtggatgatgtcgctggatcgtacgttaaatatattggggccggaatgatgctttgtggaggaatcattggagcaatcaagttgattcccgtaatctggacttcgattaaaaaagtaatcaacgctcgcaatagcgctacggaagaaaagaatgccctaggtgtgattgcattgatgttgtcggtaattttaatttttgtcgctggttttattatttcaggttcatttttagttgctcttattggtggaattctttcactattattagctttattatttgtaattgtttcggcccgtttagcaggaaccatcgggtgctcgaacgcgccggtgtcagggatgactattgcttcattggtaattatgactttggcctttgtatcaatgggatggacaaatcagaactacagtgaaaacttattgctatttggggttttcattgttaccgcaatctcggttggtgggggttatatgcaaacccaaaaagttaactatatgattggtggttccaatcatgagatgatgaaatactacatgattgccggaattgtgggggtatttacggtcgtaggaacaaccgtgatcctagctccacaattacaggtgaccggttctaacccgccatttggattaccccaagccaatttgattgcaacgctaacaacgggaattatgtcgggaaatctaccatggattatggtcattgtcggaatagtaatggcgattgttctatggatgctagatttaccaattatgacagtggctttaggtttctacttaccaatttcgactacttccatcattttagtgggagcattgcttaaattgattgtagataagacgactaagggagaagcgttaaaagctaaaagaatccaaagtggtgtcagtctttcttcaggtttaatcgctgggggctcaatcattggtttgattggtattattctacacgtgactggtttacttaaagatgtatcacctaaaggttttgccgccggaaatgcgatgggaatcataatcttaattgtattagcggttgccattgttgtaccactttacatgattaaaaaggtagaagatcggaaaccaagtgatgaaaacgagggatgagcatcagttaacagatgatgaattacgggagattgtatttgaaaagaatccacgagtggactacgaactaaaacaaggaattattacaattattaagccacaagatcattggatacaaagatttttccgcaagcttaattttaaaattcccgaaaatacttatttagatttggacgaatatgggagcttcgtatttcaacaagtaaatggtaagcggagtgtctatgagattgggcaaaatttaggtcataaatttaccgaagctaacgagtatttatacagtcgtttgtggttatatttaaatcatctggaagaaaacgaacaaattattaaacggatttcttaaatttacgaaggagaatattatggaagatcgaatcgaattgtcagcatgtacctcaatcatggtaggaaaagcagcttccctagatggagcgacgtatatttctagaaatgaagaccgcctaattgctattcatccaaagcgttttttggtacaaccagcagttagcgggcgtaaagaaacttatacatcgccctacaatgggttgacggagcctttaccagcaaacggttatcgttatacttctacgccgaatggggatgaaagtgatggtcctaatgaagaggacggctttaacgaaaagaacgttggtgaaagtgccacagaaagtgtttatgcaaacgaacgggtactggcttatgatccatttgttaaaaatggattggcagaagattcaatgactactttggtattgccttttattaattcggcgcgcgatggcgtacgctatttgggtgaactggttaaaaagtatggttctgccgaaggaaatggtgtccaatttaatgatgcggatgaagtttggtatatggaaattgtgaccggtcatcaatgggtcgctgtacgaattccagacgattgctatgccgtggcagctaaccaaattgctattgaggatattgattttaacgatcccgataactacatgtggtcagaaaatattcaaacatttgtggaagaacatcatttgaatcctgatcgagatcgctggaatttccgtcacatttttggaacagatactgaaaaagatcatcattacaatactccacgggtttggtttgcccaaaggtacttgaatccagaaattgaccaggatcctgaatctccagaactaccatttattcggaaggctagccggaaaattgcagttgaggatattcaatatattttgaaatcccactataacgaaactaaatacgatcctctcggaagcggaagtgaacacgatcgcaagacttatcgggccatttcgctatcgagaaccgctaattcacacattctccaaatgcgcgatagtcgtaaaaatggtgctgccggggtgcaatggattggatttggcgtgccaagtttctgtccacacgttccgttctttacgaatgcaaatgatacagacgtttcatatcgagaattacctgaacaaatgtcgttagacagcgcctactggctatatgaaacattagcaatggtcgttgaatcgcattatgcggaatttatccaagcggacctagattatcaaaaggaattatcacagtgggcaagaacgaagattagtgaggttgaccagcaagctgaaagccttgagggagccaaacttacggactatttaactgaacaaaaccacttaattgcccagcattataatgatgaaactaaaaaacttctagcagaactaacgaaacagggagcggaattgtcgaagttgacgtttaagatggatcctaatttgtagtaaaaaatctaaaatattttcacagtacaaaaacatattatcaacgcttttaaacgattggtgttagagcaattgtagaagcaatgataatgtgttttttatgttacattaatagcatattagaaattaaattatatgaaagcgcttgcttattttttataatggccttatactatgtttgtggttgttatatcaatataacaagttggtgataagggatgaaaagacagccgctctggcaatataaacaaataagtacggaattaattagaaaaatagaaagtggtgaattagtagttaattccaaacttccgtcagaaaaactactatgcgaacaatatgacgtcagtagaattaccgttcgtaaagcgttagcagaattagaagagaaacactacataataagacgccaaggccaaggcagttttgttaaagcacattttgaagatgcaggtattagttacattgataacaatagcgaagatctgcgtcgattaggacactcagtttatatcgaattacatgaattttcgatcttagccgatggtgaagagacgaaggtgagaagaattatgcaaatgaataatagtgagtatctatatcgggtgaatcaagtctacatatcagaccgtagacctattattcaacgtgagacgtttatgtcctttgctgattttccgttattaacttctgcagagttacaaaatacggaattaatgccattacttgccagaaaatttgatttaaatttaaagcgtttacaccatgagataagcactgaagtggaagatataccttctagattgtatggaataccaaatacttcaccaagagaatcttatatcaaagcaaaaactacgtatactaatgaagaaaatcgtactgtttacttaagtaatgctacaacagcagcatcttctaaagtattctttgtacggcataaggaggaaaatgttatgtcagaaccacatattttacttacacgaattgataaccgtttggtccatgggcaggtcggagtaacttggactaaaactttaggagcaaatttaattttggtagcaaatgatcaagcggctcaagatattttgcaacaaaaactaatgaaaagtacagcagaatcttcaggagcacagattagatttttcaccttacaaaagacaattgatgttattcaaaaagctgcggatcgtcaaaaaatttttatcgtggtaaaaacgcctgaagatgccctaaccttaattaaggggaatgtgcccattaaagaattgaatgttggaaatatgcattttgcacctggaaaagaagagattactaaaaaggtatatgttgatcaaagtgataaagacgccttaatgggtgctgtaaacatgggagttaatgtatatatacaggatgttccagatgatcataaaaccgaagttaacttttaatatttagtttataaaaatactaagggggatttgacatgtcgataactttaatacaagggctaatgttatcaatatttgctgtgatagcaggtcttgattcatggctagaagttttatacatatttagacctatcataagttgtactgtagcaggttttatcttgggcgatcctacattgggtattatggctggtggacttactgaactaacttttgcgggattgactccagctggtgggacacaaccacctaacccagcagtgtgcgggataatgactgtagttattgcgcatactgcaagtgtaggaccatctacggctattggtttatcattaccattcgcaatgttaatgcaatatattttattgatgtgctattcattattttcagtattcatgccagttatggataaagcagcagccgaaggaaataccaagaaatttgcttctgtaccatatttaattatggcaattgtaggagttttattctttgtagtaattttcttatcagcctatgctgctcaaggacctatgcaagctctagttaaagcaatgcctgtttggttaatacatggttttgaactagcaggaagtgcattacctgcggttggttttgcaatgttactaaaagttcttttacgggtcgaatatgtaccgtatttattacttgggtttgtggtagcaagtttcattaacttctcaaacgtattgccagcagctgtaattggtattgtatttgctatgattgagttctttagagataaaaagaataaacaattacaagaacaaattgaagctcttaaggaagctggtataaatggaggcgaagaagatggcatctaacgtagaaaatactaagaaaacaagcaagttaagcaaaaaagatattactatgctaggaattcgctcttcattattacaatctgctttttcttatgaacgaatgcaagctggaggatgggcttttgcccaagttcctatttggaaaaaaatttttggtaatgataaaaaggcattgtctgaagccatgtctgataatatggaattcatcaatactgctcctccattagtatcgattttaatgggacttttgactagtttagaagaaaaaagagttgatcgtcaaactatccgaggattgaaaaatggattgtttggtccaatggctggtattggagatgctatttattggtttactttgatgccgattgttggtggaattgctgcctcctttgcttcaaaaggtaacattctaggaccaattatctttttcttagtctatcttgcaatcttcttgtgtcgaatcccatttgcacatctaggatataacttaggtgttaaagcaattgatgtaatacaagataattcgaaaattatagctcgtgtagctacaattatgggactaactgttatcggagctttaattagccaatatgtggcattatcacttagtgtaaaaataggctctgtatcacttcaaaaagatttcttggataagatttttcctaatattttacctctaggatttactttcttcttatactatttgttgaagaaaaaagtatcgccaattgttttaattgtaatagtttttgtactttgtattgtatgttcatactttaagattatgtagaggtattaaaaatgacaaaaataaatacaattattacgggacatggtaattttgcttctggaattgggagttcacttaaattactatctggagaacatgacgaaattacattagttgatttcattgaatcgatgagtgaattagatttgggggagaaacttgctaacagcttacagcaagatataccaacgctctattttactgatttagcaggtggaacaccttttaaagaagctataaaaatatctattgataaatcagatgttgaagttgtttcaggatgtaatttagccgcattgttagagactatgttcaatgattatgataatgtacaagcttatgctaaagatttagttgaaataactaaaaaaacagcggatttagcagattttagtacagatattgaagaagaaaatattgaagatggaatttgataatttctaaaaagagtagacgaaaatgtctactcttttttaaataaaaccattttctttgctccatttacgagcttcaaacataatgcgttcttggtctaaagttaatacttcacgattacgcatgataaatttaccaccaatgatcatttcagtaacatcattagcgttcacgctctctaacaaggtgttttgccaatttccactaggatagaggtgaggttgattgatattgataccgattaaatcagctttatatccggccttaatttttcctaaggatccttgctcatttaaaatttgagcgccattggtgatggtcatgtcaaaaattcttttagagggcataatgttaggaatatgtttttgaacaccgtgacgaagggtcattacagaacggaaaattttcatttcattccaaagactcagccctccatgcgcagcgccgtcagttccaattccagctggaatgtgatgatccagtagttcgggtgtatcaggaacacctttaccagcattgctaaacgggcaatggcaaatttttacgtggtatttttgaataattgctttttcatgactggtaagaaaaatgctatgcgcaccgataaaacggggacccaagacatctaaactttctaggaattcgtaagggtgctgcccagttcgaacgataataccttgtacttcagcaggatattcattcatgtgcgcttctaaaaaggtatggtgtttcttagccatatctgcggcttttaaaattaattcatcagaacaagcgtttaatgctcgtagagaatagtaaactttcaaattactaatagtgttgaaattatcatacaattcattattttgttgaattgcttcgtcagcattcattctaattgcggatggtagagtggggtcgtccatcgttgaagaagacaatgccccacgtaaaccgctttgagcataaactgaagcagcactcatcatgtggtagcttccggattcgacgaaaccggttgtgccgctggtgatcatttccaaggcagcaatctcagcacttaacttcattttgggctctgttaattgagtttcgaaaggtaacataacgcgcgtccagatgatgggtttagcatcgagaattcggccacgcagcaattgctgaccagtatggacatggctatcgattagtccaggcatgaacaaataattacgtccatcaacaacagttcctttaaagttagtagaatcaatgtaatggttcacgttttttatgtatccattttcgattagaatatcttggttttcggcaagttcgccgggttgaactaatattaaagtgtttttaattttcttatcaagtaatttcgcctccatgatagatatggaattatattagtctcttacttacaaaaagtaaactttttatttataacctaaccaaggagataaaattttttaatacttcgaggctaggatttggataaaatacaacctttgttttgtcatcacttgcatcaagttgcaaaagttagctgtaaattttgttaataaatatgaacaattaaatttaaaggaaatatgggattctgaattaaagaaggtgtagatccggaagtataaataatttccctaatttacttctttaacaaggggggttaatctatttccattgatgaatcttaacgttatttttttataggaggtatttattatgagtatgaacggtgcagatttaatcgtagacacgttgataaagaacggtgttaaatatgtcttccaattacctggtggtaaacttggtcccttattaatggctttaaagaagcgtgaaaaagaaattgaagttgtaacggtaagacatgaacaaaatgcaggttttatggcacaaggaattggtcgtattactggtcgacctggcgttgtgatgacaacctctggtcctggagctttgaatcttgtgactccattagccacagcaacctctgacggcgatcctgttctagcgatttctggtcaagtaccgcaagccaaattgttaacgccttacccacagaaccctaacatttcaggcgtgatgaatgattcaactataacaaaatatgcaaaagaaattgaagatacaggcgctcttgctgatgaagtagcgaatgcatatattacaagtatcaatggcaatcctggcgcggtatttatggatgttcctggtaatgtattactcaccgaaaccgaaaaagaaggacttgaatttacggctattgcagatcaattagctaatacgattagtgatgaaaaaactatttctgatacagtaggtaaaatcaaacaagcaaaacgccctgtaactattgtcggcgctcgtgcgatggatgaatcggctgccaaggcaatccaagctttcgtaagaaaaactggtattccagtggttgaaacctttgaggcaacaggtttattgactcatgagtttaatgaaaactatgtcggccgtgttggtttgtttaacaatttgcctggtgatgaattagtctataatagtgacttagtaattactttaggtttaaatttagttgaatattgggcttcagtatggaattctgacaagaaaactgtggttgacattgatatagtggtagatcacttagatgaaacttttatcccagatacattagcacttggtaacattgctaaaaatttaaaaaacatcaccaaaacaatttctgaacaagacatcacagatgaatggaagtctactgttcatacattacaagaaaaattactgatgaaaaaacaagttcctaaaacaatttctagtgattcgttgcacccattagaaattgttagttcgttacaaaaagttattgataaacatccagatacaactgttgtgatggacggtggtagccacgaagtttggatggggtcttacttaaatgtttatcggccgaaacattttttgatgtctgatggtcagcaaacgcttggcgtaggtcttccatgggcaatttctgctgcattccttcgcccaaatgaaaagattttgtcttctggtggcgatgggagctttatgttctcatcacaagaattggcaacagttgcacactataaattaaatattgttcaagtaatatgggttgataaggaatataatatggttgaattccaacaagaactagattaccaaggacaagaagaaggcgttgatatcgactacatcggttacaaagaaatggccgaaagctatggtatcaaagcaagtcgggttcattcgaaagaagcattggacgcggccctaattgaagcttataggacaactgaaccaatggttatcgaagtgatagaagacaataaacaaaatattcacttgcgtgacaaagacgaactaaagaaatattaataattataactgaagtaatttagtccctaaccaagcccgttaattctggtacgttgtaagggactttttttgaaaaagtgcctttatctttgatgactgttactcatacaaagatatttaccaaatttctataaagagatgtattgatgaatgttgaattctttcttatactttcactgaaaaaacattctatattaattacagaaattaagtattatttatcatttgaaatattcattttccttattatattcataaaataatgaataaatacattttggagttagattaaaaaaataactaattaaaaattagcttatataattttaaaaatttatccaggaaatactactttgtgattaaataaacagtaacttatcaaggcaaacaccctatataattaaattatgatttaagtacaattagattttaatgatacgtaaatgattcacctatacttctgctataatattatttatatgtaatttgtttttattcataaatatagttaggggtagattcactatgggtgaacaaaagaaaaaactatcgcttggcgctttagttttgatgatttttacaaccatttttggttttggtaatactccaacagccttccaacaaatgggttacggagctatcttttggtacattgttggtgccattttattctttattccagcaggtttgatgtttgctgaatatggttccactttcaaggaagcaaaaggtgggatttattcttggttagaaggttcaattggtgaaaaatgggcctttatcgcaaccttcatgtggttagcttcatggctaatctggatggttatgattgctcaaaagatttggattacactagccacaatcatttctggtcatgacacaactggtagttggtcatttcttggacttaactcaactttaacagttggactgcttgccattctatggatggtgtttgttacttgggcaacaactcgtggaatcaatactttggctaaagtgtcttcccttggtggtattgctgtaatggttatgaacgttatcttgcttctcgcaagtgccttcattttaatcgctaatcatggtcaccttgcccaacctattcaccatttgagtgattttgctacttcgcctagcgcacagttccaatcaccaatcgctttaatttcatttgttatctatgcaatctttgcttatggtggtttggaatccattggtggtgttacggatagtttggacaagccagaaaaaactttccctaaaggaattatgatcggtggtgtggttatcgccgttggttattctttagcaatcttcctttggggcgtttctgctaactggaacacagttattcttgctcaaaaagctaacctgggtaacattacttatgtgatgatgcaaaaccttggtttggaattaggtaaagccatgggtatgagcccagctgctgctgcaatcatgggaactaccttctcaagatttgcgggtgttgggatgttatttgcttatgttggttcattcttcgttcttagttactcaccattgaagtcctttatcatgggttctcctaaagaactatggccaaagaagatgactgagttaaacaagaatggtatgcctgccaattcaatgtggctacaagctatcgttgttattgtatttatcgcaggtatttcaattttagcttcaattactcacaaagaagctactttcttctacaacgtacttacttcaatgagtaacgtatctacaactttaccttacttattcttagttggtgcctttccattcttcaaggctaaagaaggactcgatcgacctttcgaagtttatcgtagtcgtccttggatgttaacgattgttacagttgtacttctaactgtcggaattggtgtggtatttactgctatctcaccattcatctctggtgacttgtttacagggttctggacagttgctggtcctgtattctttgctattattgcttggattttcttggttagaagagaaaaaaataaaaatatctaattaaaaactaaaagatgagggttcattttaaatgaaccctcatcttttttatttccaatattttttctgaaattctgatcgtccacccgcttcttgaatttggtaacgaaggggatttttcttataaaattcttggtgttcttcttcagctggataaaatggttgagcatcttcaattttagtaacaatagggtcatcaaacatttcagatttggctaattgttccctagatttttcagcaatttcacgctgttcagcactattcacaaaaattactggtcggtaattatcgccacggtcctggaactgccccattgcatcagttggatcagtttgttgccagtagatttggactaattggcgatacgaaataatttccggatcatacgtgattttaacggcttctgtatgtcctgtagtatgactagtaacttgttcataggtcgggttggcgacatgccctcctgtataacctgaaacaacgttgataataccaggttgagtttcaaaaggttctaccatgcaccaaaaacacccaccggcaaaaatagcagtttcttccataagtaaatcacgctcctaattaaatagtttctttaaataacctagattatgcgcttctaaatcgtcatatgcaatgaatttcagggcagccgaattgatacaataacgatttccaccttgatcgagaggcccatcatcaaatacgtgtcctaagtgagagttagcatccttgctgcggacttccactcgttccatgccataagaagaatctcgatgattaaccactaatttagggtcaataggcttggtaaaagaaggccaaccacagtgagcgtcatatttatcggtggaactaaaaagtggctcaccactgacgacatcaacgtaaatccccttttggtaaaaattatcgtatttaccggtgaaaggatgttcagtagcagcattttgtgtaacctcatattcttcaggagacagtttcttttttagctctgctttggaccagttatttgaattcatttaaattcccccttacctataacatcgattataaaacattcatgtcttttaggggattaagatgcttacaaaataaaagctcaagttaaaacttattaattaatcgggcaatattctcagcaacttgggcaatatcatgcggagcatcgatcaatgcttgctctaaagttttaacacctgacacacttgaaaacaccgcatcgattgctttatctgaatacaattcatcgataccttcaccaatattaccagtgattacaattactggagcgcttgcagcaacagatttagttgccaatgccactccataaggcgttttaccaaacttcgtttgataatcaacaccaccttcaccggtaaaaacaaaatcagctccttgagcttgttccttaagtccactatattctgtaacaatatcaattccctttttgatagatgcgttggtaaaagctagtaagcccgcacctagccccccagctgcacctgctccaggataattagctaagtcttgatttaaatcgcgtttaataatttcagcataatgcgtgagactttcatctaaaattcggatcattgccggcgtcgcgcctttttggggtccaaaaactacggatgctccctttgggccaactaaaggattcgtcacgtctgaagcgattaaaagttggactttagctaaacgcggatcaatgtcagtcatgtcaatttgagctaaatgctttagtgcttcacctccacgaccaatttcatgatgcttattatccaataaatggaccccgatggcttgagccattccagcccctccatcattagtggcacttcctccgattccaataatcagctttgaaatatgataatctaaagcctttaaaattaattctccggttccataggttgtagttattaaaggattttgtgtattttgattaataaattgaataccacttgcttgggacatctcaattaccgcggttttatgatcacctaagataccaaatgtagcttctactggatctcctaatggaccagtcactttttcggtaattaattttccattagtagcatcaaccagtgcttgcacggttccttctcccccatctgccatagggactaacgtgtaatcagccttcggataaacccgagcaataccattttggattgcgatggctgcttgtttggcagttaatccacccttaaatgaatctggtgcaataacaaatttcatattattatatatttactcctaggttatgaattttagtatatctaatcctatttcagtggaaataaaaaacagatgaccttaagccatctgttttagtattcgtcttatgcaaatgcatccattaaaggaggtacaacttgttttttacgtgatacaacgccaggaaggtctgctgtgttgtgatctgataattcagtgttaaatgctttttcaacgatatcctttggttcaccaactactagtaagcgtgaatcacttgaaagaatgttagttgcaagtaataagaacatgtcatagccgttcttttggttttcttcttccattgtcttaactagtgcagcttcacggctaaatacgtcatcaaggtcaactgtattcacttgaccaatacggattgtctttccacccatatcaaagctcttagcgtcaccgtcaaccaattctaattcagacttgctagaaaggtccgttccggccttaagcatttctaaaccgtaagtttctacgtcgatattagcaattttagctagttcttcaagggctttacggtcatcatcagttgtagttggtgacttaaggagtagcgtatcagaaacaatggctgaaagcatcaatccagctaatttagcaggaatttcaacattattttcatggaataatttagttaaaattgtacttgtacaacctactggttcagcacggtagaacaaaggttgtgaagtttcaaagttagcaatccgatgatgatcaacgactgcagtaacggttacttgatcaagatcggaaacactttgttggctttcattatggtcaacaagcataactgaatctacttcgttggcagctgtttcgattactcgtggagttgcttcatcaaagtgtgctaaaacaaaagctgtttcagggttaggattgcctaaagcaacggcttctgcatctgctactcccaattgattttgtaaatatgcaaaggccttcgcagcaacgattgcgtctgtatctggattagaatgtccgaaaacaagttgtttattcattataaaaagtctcctttaatcatctttttttgtagttaagttacgtaccttatcaatatacttctcgccgtccatatattcaaagaaggcactcaaaaaggcgtttatccgtggaattttgtctttgtcttttctgtaaacaaacccaatttcatagctaatcttagggtcaaacttagttatataagcatcagttgcttcgtcttgatgggctaccacaaaagattccggtaatgccgtagcgatccccgtgctattcgaaaaactcaaaatttgagcgggggttgtaaagtaagcaacactcttaggtttagttaccatcgcatccttaaatacttctgtaataaggtcatccaaataataaccttctggataagatacccaatcaaaagctgctgcacgttttaaacttacgccccgtgcttttgataaacgttcatcatgatgaacaaaaactaaacgttctgttccaatcttacgtgctcggtaagacttccaactacggatattagcatccggaagatatgtaattgcaaagtctaatcggttactttctaaaccttcccaaatttcaaaacgcgtgagcatatgaacagttacattaatttcaggaacattattgtaatagttagcgataaaatcttcaaaaatacgagtttcaagcgaagctaaaatcccaaccgaaatatcaccacgtccgctacttgttgcttgttgaatctcatcagtcgcatggttcaaaatacgattgatttcatgagtagcgttcaacattgtgtatccagcgtcagttaaacgaagttttttgccgagggtgtagaataatggcgcacctacggcatgttcaagttttttaatctgctgtgttaaggcgggctgtgtaattcctaaaagttgggcactttgtgtgtagctcatcgtatccgtgagtcttaaaaaatatgacaaagttttagatgaaaaaatcttttctgtttttgtctgcatactagagcactcctttcagttagcctaaacgaactaacaatctccaataataagtctaatattagtattcataaagggcaagtaataatctgcttaatttatttattatttaaaatttcagaatctaattcctttaaattcatcgatactggtacaccttctgaatctacatcgaccaaaaagcttccattggagtaacgttcatttagtggatgctctagtggaataatatcatgaattaatcctcgtgaagttcggacttcaaaagcttcacctggttcgaccacttcaatatctgcaactcgatgtggttcttttttaagttctcttagaatttgaacaccgcggcgagcacggctagtcacactaatttcactaaccttcatcttcttaaacgaacctcgattagtaattaaaccaatctgatcatgatcgtttactagtacaaaattagcgatttcatcttcacgaagatccatcgatttaacaccggctgcgcgaggaccaacttctggaacttcaattaaatcataccgtaatccataaccattacgagtggccaaaagaatggtttctttagtcgattgactggttagcttagccacattgaccactttagcatcagctgcttttaatttaatataaacggcggcttttttacgatacgtacgtcctggtttgaaatctttgagactcgtgcgcttaatgtaaccatcacttgtggcgatcaagaatgacactggttcatcgaagttcttaacgtcaaaggcctttagaattatttcatcgtctgctaatccgattgcttgagaaatatgctctccagtatccttccagcgggtttccatgatttcatgtaccggacgataaatcagatttcctttattagttaacatgattagatgatccaaagtatttagttcctttttgaagacggtaaaatcgccctccttgagaccgtcctcttctgcggaagccttgtaggaacgtaaactactacgtttcaaataacccgattgactaactaaaaccataacttgttcttctggcactgtaatggttcggtcaaccactaactcctcaatatgttcctgaatttcagacaaacgtggtgtggcatatcgttttttaacttgacgtaattccgccgacaagacttttgataattcattaggattattaagaatgttattgaactcatcgattgaatcattaagtgccttagcttcgcttttaagctccgttacatcggtgttggttaagcggtaaagttgtaaggacacgatggcttctgcttgtcgttcagaaaagtcaaaactagtaatcaagttttgcttagcatccttcttatctttactacctcgaatagttttaataacttgatccaaaatcgaaagagctttaattaaaccagcaacaatgtgcaaacggtcttcagccttcttcaagttgaattttgttcgtttggtaatgacttccttttggaaatcaacatatgcttgaataatttctttgagtcccatgcgttcaggtcttagtttattaatcgctaccatgttgaagttataagaaacctgtaaatcagtattcttaaacaagtaatttagaattccacgagcgtcgacatctttctttagttcaatggcaattgagagtccatcacggtcagattcatcacgaatttcagcaattccatcgacttttttcataacacggatttcatcgatttttttaactaacaaagctttgttaacttcgtagggaatttcagaaacaatgatttgttttttattaccacgaatttcttcaacggaagttttagatcgcactactactcgtccttttccggtacggtaagcttgcttcaatccattaattccttggataatccctccagttggaaaatccggacctttcacaaattccattaatttttctaaagaaggattagggtgtttgattgtataaaggactgcgtcaataacttcacccagattatgtggtggaatttcagtagcgtaacccgctgaaattccggttgctccgttaactaggagattgggaaaacgcgctggtaaaacggttggttcatattctgtatcatcgaaatttaaaaccatatcaacggtctctttatcaatgtcatttagcatctcttcagcagcttcacttaaacgcgcttccgtataacgcattgcagcaggaggatcattatcaattgatccattattcccgtgcatttcaattaatgtaactcgtagtttccagtcctgactcatccgaactaaagcttcgtaaattgaactatcaccgtgggggtgaaaattacccattacgttaccgactgattttgccgattttctaaaagctttatcatgcgtgttaccgtctttattcattgcaaagaggattcgacgctgaacgggttttaacccatctcggacgtcaggcagagctcgttcttgaatgatatattttgaatatcgtccaaaacgatcgcccataatatcttcaagagccagttcttgaattttagattgattatcagccattcatattccccttctaattgttttctatatcaagtttaatttcttcaaaagtttcatttgaagtattggttggatctccagcttcatgctcatgtttcacagcttcgttgtctaggatactaccatcctcttcaagcgtgaaagccacgttgctttcaatccatttccggcgaggttcaactttatcacccatcagggtggttactcgacgttcagctaaagtgtcatcatcaatacgaactcgaactaaggttctagtttcgggattcatcgtagtttcccagagttggtctgcattcatttcaccaagtcccttaaaacgttggagggagaatcctcgacccatctgtttgctgacactttcgagttcttcatctgtccaagcgtatgcaattttaaccttcttattgagtcctttttgtaacttataaagcggtggcaaagcgatgtaaatttttccggcatcaatcattggccgcatatatttatagaagaaagttaaaagcaacgtttgaatatgagctccatcagtatcggcatcggtcataatgattactttatcgtaattactgtcttgaacattgaattccggtccaactccagctccaatagtataaataatggtattaatttcttcatttttaacgatatcttgtagtttagccttttccgtattcaaaacctttccccgtaatggcaagatggcttgaaatttacggtttcgtccctgtttagcactaccaccagcagaatcaccttcgactaagaataattcatttttcttagagtttttagattgtgctggagttaatttaccagataagatacgttcttgtttctttttccgttttccggtccgcgactcatcgcgagcttttcgcgccgctactcgagcttcacgggcattgatcgctttacgaactaactgttgggcaaattcaccattttccatcaagaaaaagccaagttgctcactaacaatggcatccacaatcggacgagcttcaggagtacccaatttttctttggtttgaccttcgaattccaataattcttctgggatgcgaactgaaataactgcagacaaaccttctcgcacatccgagccttctaaatttttatctttttcttttaacagtcccattttacgggcaaattcattgaaggctttggtccaaccggaacgcatcccgacttcatgggtccctccatcacgagtacgtacattattcacaaaggaaaggatcgtttcagaatagccatcattgtactgaccagccacttctacttcgattcccttttttgtaccatcgaaatacatgatattaccaagggtatctttatcttcattaagataatcgacaaattgcttaattccctcatcgtaaaggtattcttcgtgttgttcgtgtccttcacgccgatccgttaaagtaattttaaccccacggagtaagaaagctgattcgcgtaatcgtactgctaacgtattgaagttaaacacagttgttgtgaagatttctttgtcaggtttgaatgtgacagttgtaccgtttttgttagttgttttaccaactttttttagggttccaactgggtgccctccgttaacgaaagtttcttcatatttaactttgtctcgcacaatctcaacggttaatttttcagatagagcattaacaacactagcacccacaccatgaagcccaccggatgtcttataaccaccctgtccaaattttccacccgcatgtaaaacggtaaaaataacttcaggtgtaggtttgccagatttatgcatccctaccggcattccacgcccgtgatcgaccacagtaatgctgttatctgcttgaattgttacgttaatttcttttccatatccaccgagagcttcatctacggcgttatcgacgatttcgtaaactaaatgatgtagtccacggccatcggtcgaaccaatatacataccaggacgcttccgaactgcttcaagtccttctaagacctggatggatgaatcatcatacgatgttttacttgtttttgccattcatgttactcctttaaggtcagtactattatcataacttatttttaaactgatgaaaacatttcgataaatgttataatactgcattgttactgtaatttattacaattaagtcaaatgtataaaatatgcaggattttttatagaaaagaggaaagaacatgatagaaattattatcatgctacttgtagcttatctcctaggctccatcccttctggagtactggttgctaaacattttaataaagatttacatcaagaagggagtggtaacactgggaccactaataccttccgcgttctaggcgtaaaggctggcgttttggtgttgtgcatggatcttttaaaaggaacgatcgccactttgcaaccgattgtcttccatgtacagggaattaatcctttaattattggtttaggagctatcttaggtcatactttttccgttttcgatcattttcgtggcggaaaagcggtagctacaagtgctggaatgctgctagcctataatcctagttattttttaattgcctgctgtctttttattttcttcatttacgtatccagcatggttagtttttcgagcatcgtgtcctctccactactggttattatctctcttttttaccacgattggattttaaccatcgtagcggtagcactgacgacctttatcatatatcgtcatcgtacaaatatccaacgtattctggctggaaatgaaaatttagttccatttggactctattatcgaaagaaaaataagtagctgcggtttgaattacatacaaaacccctaaaagattaggtttcgccttactaactcgcgaacctgaccctttaggggttttctttttagaagaatgacattgaaaattcttgattaaatgtttcttgtgcagctaaacgatttacaccaagcttatcttttaattcaccattgaaatcgacagtatcagcaattccccaccatggttctaaacaaacaaaattagcagtggctggatatggtgaccaaataccaaggtatggagcgttagcaactgtaaacgcaataccgtgattattcacttcattttcggtcattaaggtgatttgttctcccttaaggtccaagatgatggcgtcatctttaaagagcgcatgcgttaaatcaagcggagttgtagcatcaaacttgatagggtttttaggatccgtgtaaggtgccttaagtggaatttgattatacacttgtttaggcgcgattcgaatatgagtatcttccatctgaatttggttatctccaagatttagattaaatccagggtgcccgccaatcgaaaataataaatcttttttagaatcaggattaactacttcgtaatgctcaatcaattcatgatcctttaatgtgaagtgcaaacgtagtttaaactcaaatggaaatttttgaagagtttctgtatcgctatttaattccataattacgtgttgatcatcttgttcaactgcttcaaaatccatatcccgtgcaaatccatgttgacccataggataagtttgatcctcaacttggaattggtcatcctttagacgtccaacaaagggaaataacactggggcatgtcggccccatactgcagggtcggcttgccaaatatattcaatcccatcattagccttaacactggataactcggcccctttttcgttaattttgactgttaaatagtcattttttaaagtaaccgtcatcggttgaaatcctcctactataagataaactcactcagatctttattttgagcaatgctaccgattttgtcatcgacatacttttcagtaatcgttacttcgcccatttccattgaaggaccttcaaaaaggatatcttctagaagatgttccaaaatggtatgcaaacgacgagcaccaatattttcggtttcatggtttacttgttcagcgatagctgcaatgcgttcaatggcttcgatcgtgaacgtaatcttcacattatcagttccaatcaatgcaatatactgcttaactagtgcattcttaggttcagtgagaatcttaacaaagtcttctttagttaagtcgtttagttcaacgcggatcggaaaacgtccttgtagttctgcgattaaatcgctaggtttactttcatggaaagcacctgaaccaatgaatagaatatgactggtgtctactaaaccatacttagtacttacttgggaaccttcaacgattggtagaatatctcgttgaactccttgacgagaaacatcactagatgaattttgaccagagccggtaattttatcaatttcatcaataaagataattccagtattttcggctcgttgaatagcagcgtgatacaagtctccatggttaaccaacttgtcagattcttcgcggattaaaatttcacgagcttctcgaacagctaccgttcttgtaatctttttcttaggcattaagccattcaaagattcacctaagtcgatccccatttggttcataatattgccactgttattttgcttaggatcgtccatttcaatggtaaccatatcattctctaggagacccttagctaacttactagcaacattcatccgtttttctttgatatcatccggcactttttgagaactttggtttaagttatccggtgtacgtccttgctgtaattgattaagcatgttcatcatgttttgaatatcagcagcattgtttttattttgagtatccgttggaacaggaacgaggagttctacaatgcgacggtccgcattcttagaagcttctgctcgtacatctttaaaagagttttcttcttcgatgtgcaccgcattttcgactagatcacgtaccattgattcaacatcccggcctacgtaacctacttcagtaaacttagtggcttctacttttacaaaaggagcattaacgattttagctaaacgccgtgcaatttcagtttttccgaccccggtaggtccaatcattaataaatttttaggtgtaatatcttcttgcatatcaccagaaagttgtaagcgacggtaacgattccgtaatgccaccgctactgcgcgtttagcacttttttgaccaattacaaattgatctaattcttgaacgatttcttgtggtgttaaattatcttgcatgatttagtcttcctccttgaaatccaatgcaataacattgtggttcgtaaagatatcaatatcacccgcaacgttaatcgcagttttagccatttctttcgcactaacttgcgtagcatgcttcttgagggctttagctgcggccagcgcaaagttaccgcctgaaccaattgctaagattccgtcatcgggagcaataacttcaccacttccagaaacaagatacatctctttttcgtccataacaattaacatggcttctaatttttgaagttgttgatcaccacgccaaattttggctagttcaacagaagctctttgtaaattcccactatattcagaaagcttcttttcaaatttttcttcaaggttaaaagcgtcagcaacacttccggcaaaaccaacaatgacctttccatcataaattcgacgaaccttgcgggcagtccctttcataataaatttttcacccattgttacttggccatctccggccatggcattttcaccattatgactaatcgcaataatggttgtcgcatcaaattttactggcatttgtattctcctttttaattaagcatcagtcgagcgtggaaaatattttcggtagctctcttgtagtttttctttagtaacatgcgtgtagatttgagtagtcgataaactggaatgacccagaagttcttgaacagtccgcaaatctgcaccgttgtttaataacgccgttgcaaagctgtggcgtagcatatggggatgaattttcccatttaagctgctggcggtaatgacttggttcaaaatgtattcaatcccggttgtggtaattggcttagcataatggttaataaaaacaaaattatgggtttgtttatatttactcaaaaaaggctcccattcattttttcggtaattttggagcgcttctttggcataccgcccgaagggaacataacgttctttatttcccttccctagaactaggatagtttgcattgaaaagtcaatatctaaccattgtaacgctgcacattcacttactcgcatccccgtaccataaagcacttctaaaatcgcaatattgcgtagcttttgcgcaccttccgcttggtaaaccgcttcaaagagcatgttcatttccttttcataaaagaaatgtggcagcttgtcagattgtttcttcagttggactaattcaaacggattcttatccactaaatcattcttaactaaaaaacgataaaaagagcgcaaagcagatacttttcgcgaaatcgaagttcgagctaaatgtcgatcgaataaataactcatataaacattcacatcgaaacgatccactaaaagtaggtccgttttatcacccgtgtcagttaaaaatttttggaatgcgtcaatatcttctaagtacgcagtaaccgttttctctgaatattgacgttcaaccgtaagatactgtttgaacagtgaaattaattccataaaaaacctccaacacttgtcactgtagcaaatgttagaggtaaacgtcaattaatattttattttttaaactatttttgaggtgtttcttcgtagtcaccatttggacaaacaatttgtttgccgcctttaattttcttttcaatcaagtaactatgacaaacaggacattcacgagcaattggtttatcccatgacacaaagtcacagtctggatacctagagcacccatagaacaatcgaccgcgtttagatttacgttcaataatttgcccctgatgacacttaggacaggttacaccaatttctttaacaattgcttgggtattacgacagtctgggaaacggctgcaagcgaagaacttaccgtaacgtcccattttgactaccatgggtgaaccacagatttcacaattaaaaccagctagttcgtctttaatctgaactttttcgatttgttcctgtgctttagccagttccttagcaaaaggtttgtaataacggtcaacgactttcacccagtcttccttgtcttcttcaatcgaatccaagtctttttccaagccagccgtaaaatcgatattaacgatatctgggaagaagtcataaataatttcattgacgatttcacccagttcagtaggttcaaaatgtttagactctaacttaacatagtaacgcctttgaatcgtgtctaaggttggagcgtacgtagaaggacgacctaccccattttcttccaaagctttaattaaagtagcttcactatagcgagctggtggctgagtgaaatgttggttcgggttgttggtaaccagttggacttggtcgccctcttctagatttggaagaacgttatctttatccttattggtcttgtaaacttttgtgaaaccttcaaatttggtctttgatccgttagctcggaattgaactccattttgttcaatcttaaccgtcatggtatccgagacttctggtgtcatttgactagcaacaaaacgggaccaaattaaattataaagcctaaattgatctttattaaggtattctttaatactttcaggagtccgcaatacggacgaagggcggattgcttcatgggcatcctgagcaccctcgggcattttacccttccgaggcttagtagcagcatattctgcgccaaactcatcatgaataaataatgaagtttcgtgcttagcaacctcggaaatacgagtcgagtcggttcgcatataggtaatcaaaccgacagtgccttctttaccaatgttaattccttcataaagttgttgggcagccatcatcgttttacgcgttctgaaattcaacgtcttatttgcttcttgttgcatagaactagttgtaaaagctggagctggataacgtttgcgttctcggcgtttaacttccgtaatatcaaaatcagccttagggtcgattttctttaatacttcctgaaccttatcgttattaggcagcttcatctttttgttattcacgccataaaaggcagccttaaatttagagcgtccttttttaaattcagaatcaattgaccaatattcttcaggttcaaacgccttgatttcttgttcacgtttaataattaaacttaaggcaattgattgaactcgaccagcactaaggccttttttaactttttgccataataatggagaaatcgaatacccgactaaacgatccaaaatccgacgagcttgttgagcatcaacgagcgtcatatcaatgctacgcggggttttgaatgcatttttaacggcatctttagtaatttcattaaaaaccactcgattttgatctttgggatccaatcctaatagatatgaaaggtgccacgcaatggcttctccttcccgatcgggatcagatgccagataaacttttttagcttttttagcttctttacgtaaatttttaatggtatcgcccttaccacgaatagagatgtaatggggttcgtaatcattttctagatccacgcccatcttactctttggtaaatcacgaatatgtccaagactcgcaactactttataggtacggcctaaatatttttcaatggttttagccttggatggtgattccacaatcacaaggttttttttcgctgctggcatttgttgctcctttgccttgttatatttaaaattttatagacaccatgttattgcataatattcgatattgtcaaataactatcattaatccagttataatttcaatcgaatttatccctaaatgatggtaataatgatactaaatccgcttaattattaataaaatttctaataaccgtcagaatccagctaattataccccaatttaaaaagatggactacccgttttgtagcttctacagggctttattcaaaataagagatgacattttagttaacctaaaaaatgtcatctcttattctaaaccattagtctaattgtgctcgaatgccagctaagctaacttcatttgtagtatcaaattggatctgagcttcgggtaaatcaccaattccaattgaaagttcaccagcagcattaattgattgaatgccagccgctgaatcttcaatccccgctacatgattggtaggtaaatgtaatgcttgagcagccttttcaaaaatttcgggatcaggttttcccgctttcaacaagccagggtctacgattgctgcaaaatactctgtaacttttagatgttcaagaattccaggagcatttttagaagctgatgctagtaccaaacgataatcatgctgtcttaattcgtctaaaaaagcttgaattccaggtaaaatatcgttaggtgttagtttagctattaaaagttgatactcattatttttttgttcagctagggcttgtttttcagctaagctaaagtcggcttgacggttgccagactcgaggattaattccaatgaatccatgcggctaactcctttaagactcgctgctaacgttggtgtccagggcactttaatttgatctgcaatattatgccaagcctgactgtgaaacttcgcagtatctgcaataaccccatcaaggtcaaaagcgaatccctttatatctgaaaatttcattcctaattcctccactcagcttaattcaactttcttaccatttaaatcaacgcttagtgggctaccactaatcaatttaagatttgttgcacttttatcgacactaacttcaattactcttccgcggaattgttgtctaaatcggtaagatgtccaatttttcggtaagaatggggcataatgcagctgatcattacggacccgcattcctgcaaaaccttgaacaatcgctaaccatccacccgtcatggacgtaatatgcagaccatccgcagtatcattattataattatctaaatctaggcgggcggttcgttcatacatctcaacggcttgagcctctttgtgtaagtcagccgcaagaactgagtgaatagcagccgataaactagattcatgcacagttagtggttcataaaaatcaaaattccgctgtttttcttccattgaaaaatcgtcaatgaaatcccaaattccttgaagaacatccccttgtttaatatatggtgaacgtaaaattttatcccaagaccaattttgatttagcggtaattgttcctttggcaatgaactaactggcttcaaatccttatttaagaaaccatcattttcgacaaagattccgcgcttagaatcttctggtaaatacatattatcgataatttcttgccagtgttgacgttctgctaacgatacattaacttttttggcaacgtcctcttcgatctgatccaaaatttccaaggtataacggagtgtccaccgcgccaataaattggtataccaattgttatcaacgttattttgatattcatcaggaccagttactccagcaatcatatattgtccattttctgctgaaaaatggacgcgatcagcccaaaaacgagcaatttcggttaaaacttcagccccttcgttaaggacgtaggactgatcacctgtataacgggtgtagttgtaaatagcaaacgcaatatcgccattacgatgaatttcttcgaaagtgatttcccattcgttatggcattctatcccattaaaagtcaccatgggatataaagctcctttaagcccctgttccctagcatttacaaaggcgccatctagctgattgtaacggtactttaacaagttacgaacgaccttagactccgatacacctaggtataccggtacggcaaatgcttcagtatcccagtaggttgcaccaccgtatttttcaccagtaaaacctttaggaccaatatttaagcgcgcatcgttaccataataggtagaaaagagctggaataaattaaaccgaattccctgttgggcttctgcatcaccattgatttcaatgtctgatttttgccatctttgtttccattcttgaacatgctgttctaacagttgctcgaaactttgcgtcttaatcgtatgcgttaattcctgcatccgttcgtttatttcatcgactgtaccaaaatctctagatgaggcaaaaatggttcttttctccattatgctagtcgtagcaggttgtaaagctatgtgatacttttgaccgatcgattgatcgttttctacatcaccgacatagtccatatccgtcttgatgatcgtatcaaaacctaccgtaaagcgttccgtgccaaaatcattttccttggttttggcaagcattttcacttcgttttgctgactacttttagcaagtacgtcccaaaattgttcaccgtaatttgaatcttcgttgtaaacatcagcatcaatagcactaataacttcaatatcagctttgctatcagataaatttttaatcgtcagacgttgtccaactaattctttaagtgcggcactcacgaaacgttcaaaaataaatttcagttttacgccaccaatttcaaccctaaaactccgagttaaaatagctttttgcatatctaaatctaggctaaagtcttgcgatacttgatggttcaaatctaattgttcaccgtttaccgtgattaaaagtttcataaaattgaccgagttgattaccttaccaaaatacttcggataaccgtttttccaccaaccaacacgagttttatccggataccaaactcctccgagataaattccttctaaagtgtctccggagtaaccctcttcataaaatcctcgcatacccagattttcattgcctaggctggtgattgattcttgaattcttttattttcaggatcccactggttagtttcaatgtgccaaggtgctatattaaatgttcgaatcatgattgttctccttgtctatatttaattattcagcaaaagtttctttgattgttcctacggcgaaggctcctaaaagcattactgcgccagcaagtaggaacatattagcttgtgagctacctagaagtgggaataagccaaagctaagtaaggatgccacaatctgtggtaaacaaattgaaccgttgaataatcctaagtaagttcccatatgatttccagataaagcatttgttacgatggttaatgggtaagtattcattccagcccaagcaattccaactaggatataagaaacaattaaaatgtattgattatgaacaaagaaaacggatacaaaaccaagcgcaccaagaattaaactaactgcataacctgatttgtggaatcgattgggtaatttagccaaaatgtatgaacatgctaccgctgcaatcgattgaaccgctgctaaaacgccgtaccagttaccagctgcttgatatgcggccgaagatgcattagcagtgtgccaaacgttttgagcaattgcacctgctgaatatgtccagaggtattggaaagcgaaccaacagaagaattgaactaacgtgacggtccaaaatgctttaggtgctttctttaaaagcgtaatccaattaccaccttcactattctctttttcactaattccgtgatacattgcatatgtcgctggatcatattcttttactctaaatactgtaaataaactagttataattaataaaattgcacctgcatagaatgaaataacaactgattgaggaacgacgcccttattcgcagtgttggcaactcccaaccaagttaaaaggaagggaaaaatagctgctaaaactgcaccagtattagataagaagctttgaatcccgtaagcataacttttttgtttatcgtttaccatgtcgccaatcatcatcttaaatggttgcatagcaacgttggaagatagatctagaaaagctaccgtaatcgccccaaaccagagtgccattaatgaaccataaccaaatccaaaactacctgaatttggcagcagtagcatcacaataacagcaattaaggttcctagaattagataaggtaaccttctaccacctaaacgtggtttccaagttcgatcggagtagtaacctacgataggctgtacaatcaaacctgccaaaggtggaagaatgaaaaaccaccctaagttgtttggatccgctccaatcgtttgaaaaatacgcgacatttgagaactctgtaatgtaaatgcagtttgaacaccaagaaaaccaaaattaatcatccaaatcaaattcttggaaagcgtcggaagacccttcccacttgtcttatctgccaatgataacaaccccttttaatttttatgaagcgctttcatgttattaatttaacatagagatttaaattgtgcaagcgtttgcacttaaattgtgcaaacgcttgctttttgacaaaataaaaaaagaggtattcctcttttcttaaaaaatatcaaacccgactgtcgcttttcttaattcggaatcgaatagtagttcaaccgcttttttacctagttcccgtggtcttaaatcaactttattaacggtggggccggctagactaatcaacctactattattaaaacaaatcgcggggatgtttttaatatgctggttttcttttaatagatgataaaagcttagcaattcaatatcatccgctccaataatggcatcaatctcaaaatggtgtttcatatatttatcaatagctactttattattgtttttttcaagtttatatattaaggggcctgaaccacttttagtgctcatcacttgctgatatcctaactcacgctttttttcatattcccaattataagtagatctgagaaaaagtggatgtttagcattatactggttaaacataaattcagtaacttcacgtcccgctaaaatattgtcattatcaataaaacggtcattttcattcgttggttcaccgataataacaaaatttaactcttgcttcctaagataattggttactacatcgtctgctttagaatacagtaacaagaaatcgtggatttggctttgttccaccattcttttcacattgtttaataacgcttcttcagtttgacaaattgcgacagataaaacaaagtttttgagttgtaacgctgtgttaattcctcgcattaagtcaatatgaaacggattagcaggatcttcgtcagcggttactgggtaaatcaccccaatttcattagctttgcctagggacaaagttttggcgctggcattgggcttatagtctaattctttagcaattttcttaactttttcaatggttgttgcactaattctaggattattatttagtgctcgagaagctgtcgaaactgatactccagcttctttagccacatctttgattgtaatcatgcatatacctcaaaatttaatatttacatatacaagtataacttcctagacgatgaaattctacatagcgtcctttcatgcctagatacaatattccttacaaaacttcttctagaacgtcatccaattcgattaatggccgagcaccagctgcaattaactggttggttccttggctattaccactgaaaatactccccgggattgctaaaacatttcgattttccgtgagtgccagactagccgtgattaagctcccagaattctttcttgcttccactacgcatgttgcggtggtcaatccggcaataattcggttacgttctacaaaatgatgtcttaatggccgagccccctggggagattcacttagaattaaaccttctttttgaatttgattttgaagctgagcattttgcttaggataggtaatatcgagcccatttccaattacggcaatggtagatcctgcatttgctaaagttgcttcatgaaccaacgcatcaactcctttagctaaaccactaacggtggttaattgattagctactacgcccggaattaaacatttaatggcttgttcaccataactcgtcatcatcctggcgcccacaattgcaatagcactttgatggcttagtagcaatagatttccattgtaaaacaaaactgtaggtgggcaatatatctcccgcaatagcttagggtacatttcatctagaatggttagaattcccccactttgttcattaatttggatttcgtgggttagttgttcactttgtaatgtggcagttaattcatctttttgacttttcttaattagtttcgttgttccaatccactctgcaatggataattcggggcttttacgaatttcttggtaaatttgatactgctttttaatgcctaaattcgtccccacttttactctaatcaaaaaatcacgtatttccatttgatcacctcaaatgtactttacgtgtttttaggttaatttattttattaaaaattcaggtaccggttcaaaagtctgacgatggatgggagttaccccataagtttttaaaccctcaatatgttgcttagtaccgtaacccacgtttttatcaaatccgtaacctggatagattgcagcataagaacgcattagatggtcacgatataccttggcaacaattgaagcggctgcaatactaatacttttagaatcacccttaaacatcacagtttttggaatttctatcggcgcattgactgcatcaatcaacaaatgttgtggagtaacatttaagttacccactgcttctcgcatcgcaagttttgtagcatttaaaatattaacttcatcaattttttggttagaacagacgccaataccgacgctcacagcctctgtaaggattttggcatataattcctctcgcaattcactactgagctgcttagagtcattaacgtcgattaaatcgaaagtttcatccaagactacactggcagtgacgaccggacccgctaaacatccccgacccacttcatcaatcccggctactaagtcaattccatttgaccataattctcgttctaacgtaaatcgtgcttgaaatgcttctttttttaatcttaattggttaatttctttttgtttatgtttaattaagcgttgaacaccagttcgtgaatcttctgaaagttcaactaataacgggtcatctagtgtataaacacttaaaagctgcgtcttaatttccttaatcgtcgccaaggtcttcaaactcctctacaaagtctaaagtgaaacgacccagtcttcctttacgtgcgtctaacaagattcgctgactagcacgatcgtagtcgtcacgcatccctaatttttgagtaattagtagtaacaattcaggtaattccatttctaaatcgtcttctgttaagtgataacgttccatcaatccttcacgataatggttgatgaatatatttagaccatagattacaacatcatcattagcaaataaattatctttaatcgctccagtaaaagccaatttatttcctacattttggtcttcaaatttaggccataaaattccaggagtatctaaaagatatagtccgcgacgtgaacgtaaccattgttgttttttcgttaccccggggcggtcacctgtaatcgccaccttcttattaactaagtggttaagcaacgtagatttaccaacattggggattccaatacacatggaccgaatttcagcatttttaattccacgatcagccttgttagctagcttgtcggctaaaatttcttgagttttcttcaaaatgatattttcagttgagggctctttagaattcaatgcgatggcgtattcgttccgtgatttataataatctaaccattttttagtctctttaggatctgctaaatcagccttcgttaagattaaaagatgaggtttgcttttaataacatcttcaatcattggatttcgtgacgacactggaatccgtgcgtctactagttcaaatacgatatcaaccagttttaatttttcttcgacctgacgaattgccttcgccatatggccagggtaccattgaataattgccatgtttgtttaactcctatttcgttgggcttttatgccattttttatatttaaactaagctattgttaatctaatactctttattttagcatggttttttcagttttggtttttggattgaatggataaagttttaagattactaattctttcctttagctaaattggtaaccgacataattttatttttgaaaaaatattttctgaactgaggcaaattttagttattaaaataacaaaaccaataatcctcattctgaaccaaaaccaaaataaaaagcgaggatcaccgaaattaatctgtcatcctcgcttttcgtaaataaagtccaaagtaaactacctgctaagttaggcttgctcaatcacgatttgatcatccttcaaatcagcttttaaatgcttaatgtccaaatgatctaaatagaaatctgttaccttatcgcgaatttgttgttcaatcacccttcttaatggacgagctcccattgcttcgtcatatccttgttccatcaaccaatccttagctgcatcggttactttcaaagtcaaatcctttttcgctagtgttttttgaacatcagaaatcattaaatcaacaatctgacttaaatctttcttagttagatgtgagaattcaacgattccattgaaccggtttaggaattctggacggaagaatggagccaacttatccattaaagtttggtctttatctgcatcaccagttaacttttcattaccaaatccagcattggatgtagcaataataatggtattcttgaagttaattacattaccttgtccatccgtcaaacgaccgtcatccattacctgaagcaaaagcgtcaatacttgtggatcggctttttcaatttcatctagtaatacgattgaataaggatttcgacgtactctttccgttaaggtattagagttatcatcatagcctacataaccagctgatgtaccaattaattttgaaacagcggcccgatctgaatactcactcatatccaatcgaatgattgcatccttatcaccaaacatgtctaatgctaattgtttagctaattcagttttaccaaccccggttggaccaacaaataggaaactaccaataggctgttcaccttctgaaaagcctgctcgattccgacgaatagctctagcaaccattgctaccgcctcatcttgaccgataactttactctttaagcgactatccaaatcttttaaccgttcaatatcattagcacccatatctgagactggaattcccgttaatcgttctactgattgagcaacatcatcaatggtagccactacttcttcctttttacctacattatcaatttgcttattagtagcctcaatttgttgcttcaaatctgcggcccgcttaaagtcttctttttccaccgcttgatctttttctttttgcaattgattgagcttttcctttaaagctgtttcatcattttcaggttgatgtgctgccaaatgagccgctgtcatatcaatcaaatcaattgctttatctggtagcgttctttgtggaatatattggatggagtaatctaccgttgccttcaaaacatcatctggcaattttacatggtgatgttcctcatacaagtttttgataccctttagaattttaagcgtgtcatcagcattaggttcattgactacaacatcattgaatcgacgagccaaagctgcatttttcaaaattgtattgcgatattcatcttgggtagtggcaccaataacggttagttcaccacgagacaatgctggcttgataatatcagctaagcctttaccaccgtcttcaccacctgttgaaccagtaccaataatctggtggatttcatcaaagaatagaataatattgccagcagccttaacttccttgactaagtctttgatgttctcttcaaaagaaccgcgatactgagttccagcttctaaggaggacaagtcaatagagtaaatttctttgtcccgaattgcttctggaactttaccatttacaatcgcttgtgccagtccctcaactatggctgttttaccaacccccgcatcgccaactaaaattggattgtttttggttcgacggcttaaaatttccgctgtttcttgaatttcattttcacgtccaataactgaatctagcaatccatcgcgtgcttgttctgttaagttggttcctagtttttctaaaataccgccctttttaagagcttgttgtccatctttagatacttcaattgtttttgcttgttctggtaatttaccagttgctcgatattgagcaaactcgtctggagttaacgattgaccattaaccaagtagcgagcagaatctgagttaggattccccatacgtttaaatacttgattaaaaatatcatccatatcattgttgaaaaaaggatcatttccgtaaaaattggccatataacaacacctccgttaattaaataaagtaaaattgtgtcttaaaactaagtaaaaacactcttttttacttacaactgtattataactcctttttagcactctgttaagtaaagtgctaatcgaatcacaacgttaactattttcggacgattataactgaaatttatgtttaccgttgcaatataatctctgggtactaaaaaactagctaaccaaaactaaaggattggttagctagtctcatgaagtttctgattcagcttgcttgaaaaaatatcaatcagttgggggcatcttccagtgtccatcttaattcaccatggtaactaccaatttgatccataggttctagtaccagttggagatactgacttaaatctaaatttaaattcccagtatcttgcacaatcgtctgattctctccgttgattacattacccttaaaataaagccttgatataagcttttgatcgttttggttagttagtggacgttcttctcgaacctttaaaatccacgggtagtggtcaagctcactacgatctttaatatgtacccactctgttctagttagtgaacagaccgtactttctagcggaatttcgtgcgaaccaaagtcgattttactaggtaatgacagctccggaccgcgttcttgtttaattatccgagtttctttattcgacatttgatgttggtcatcttcgaggtaaaaatctaccttcttattaatccatgactttggaaattggcttataatttcatcatcaacctgatgagcagcgttggaatactcttttagtattcgcttttctcccgcgcagtttcctaccaatctaacttttgctccatcttcgtgcgtaaaggaaactgtaagtttgctttgattagaaaatcgtgaaatatagagtgcatctcctagattttttagtttaaaactaagtttttcgcctttacggtaccgatgaatgattgttttatttcctggtaagaatgtaccagtattttgaactgcatcattcttgatgggaatgtaacctgcaattttaggatatatatcagccacgtcaaatttcgtggttaaaatgccacttttaacttctcgagcgcgaagtacctcgaaaccattgtccgctaaaaaaacaacattcaccctaccaacatagtctacagttgaaactgcgttacttatacctacagcttgcccattgacgctcgttgatacgtcaaacggtaaacctaattttccattaacaacccgagttggatctacagtttttttagcttcaagccactttaaatatactttataatgcagcgtagtatcggttattgctttagtagcagttgtcctcgtcttgatgtagactttctgattctcaattcgccaatcaaagtattgcgttacatctttcccatcaaaattagtaactttaatccgttctggaatatattgttcactattataaacatgttccagattaaaactaacctcagatgtgaaactattagtactaggtaccgtctgttgagccgccaaatatacgccatcattagcttgattaaaatcactactttccgcataagctggcgcagactcaggccttgctaaaaattcagttaaataaactaacgatgaaggtgtactgtcattattgtgtaccacaaaagtaacttgggaaatgggtttagtaactacttcaaaactttggcgcggatctcgccacggaatcccaactgtagtattttttaaatacatccattgatcttctgattcatacctaatattagtcgggttattagcgtaaactgcactaatcacagaattgcaatcttggtatccaatgtacttgttagaattaaggccgaagtaattaaatgctgttttaatcgtcagaggattttgattggcttcaacaaattgataagtaaccattacctcaccagcaatatcaattcccaaaaaataatccttagcaaagcttagtgatccaccctttaaattacttttatttcgtttcaacgttaccagcaaatttacagatttaccttgataaagcccaacatttcctacaagggcctggctcacctttattttctgatcaactgatagccgattcgtggtagcatccccatttaagggagtcacctttgttcgagcaccactatgcattataaaggtattttcagccggtgtaatcgcttgattggcccactgaaaattttcaagattagacaatggcttcaagctagcctttacgtcggtagctatccagcagaaacttacgagaaaagccactaataacaaacctttaacttttttcattagtcgtcctcttacctacaagaatttttttaattccatttttgatcagtatatagcaaatcaaacctaacccaatccaaaccatccccatcgcaatatcttcactagtttgtggtaaatattgtggtctggcacttggagtagcggtttgttttggacttttcttagtggattgagcgactttttgcattggtacgacttggctagcagcgtcattttgataaaaagtaatcccgattttactattagtagattcgttagctaacgcaattccattaatgttaagtattaatggaaataatattattcctccccaaaatttcatcttacttctccgttttattatttttctgttttacgtaataaatataaccgctcaaaattacaattattccaatcaaaaatcctattattaaataaaacaatttattatcggtttttttaagttcaacggtcttttgatttaatttggcatcgtctcctgtaattttaaattcccgactaagttgccatttcttgcccgtagaactacttaaatcaatggttaatacgtatcttccactttttaagggttcatcattccaactaatgggtagtcgaaaacgtgtccgcggtgcaatcgagatcttcttatgcgttctctttaaaatttcatggtgattttttttggttacggtagcccgcacgtctaatttactcaacaatacaggagctgcattttgtaaagtagcaaaaactgataaatagccgttatctaatcctggtatagcctttatcaaacttaacttaggttgtattttggagcttgcacactctaactttgtaccaatggtataagcaaaattattggtcaaacttaaacctgatgcactagtggcagccttaactggttttgtgtaacaataaaatcctcctaaaaccgttcctttaaaaccttttggtggaatcttcaactgaaagctaactcttcgaacttccttaggcttaagtaagaccgtttgtggtcctgaaataagctgtttaaaagtagggccgcctagtaatggggcgtttgatttagaataatcaatagctccattctgattagttatcgcattattagttttaaccataatggtttgctttgcattggttaagttacgaagtcgaataaataacttttgcgtagctcctggacgtacccgtaagtcgtagtaactaacttcggaatgctgatttttcggtaaaattgcttcagcattaaacgttacttgattatttacttttccactcgcattaattgaatttggaaaaataagtgttagcagcaacgtcattatataaattagaataatactaagtaatctacttttaatgtgctgattatttatactaagatggcgcatcggtcaatacccaagttaactcagctgaataactttgcgcttcaactcctgcacgtggtacgtggagtttaacattttcgttattaccatttttaccttcaaaaacagctgcaaaagcccccgctccttcgccttccttagcagtcattaccacttgatatgctcgatttaatttaaagctatcttgagtgatttttggcatggccgatttattattcttagttaccactttcccattagataaggacatctgagcacctacgagttcttttccattagcacctacaaaaggtgtaattgcaacccctaaagaccaaccttttgcaccaccacgagtgtcattaacttgaacatgtggtttttggtttaaggcgtagtaattcgcgtctgcttgcttaatttcatgttctccgaatgtaatgtttgaagcatacgggattgttagtgaccccatgtctcctgttcccgagtcatcgtcatgggtatcatcgggcacaacaggataaacatcctttccagaaccagctgttaaagttacatccgtgtgattcgttgcttctgatatttgtgaagccattgctgtattggtgtttatcgcaaacacaccgattgcaattgtcgttagcatcattttattcattgcatacttccccctcaaatctaatcaatcatttgatttaaaattattttcgcatgtcatctgaggaacttactagtctaatttttttcttgattctgaaaaaaattaaagtgttttgggcaataaaaaaagatgcaattaacctaattacatcttttatttggttaagcgataaagcattgcacctaactgccgccaattacgttctgtaggtaagtttttcattaaaataagtggacaatctttagtatcaatatagtaattagaaatcaccaaatctacttctgaaactggtgttttatagtcgtaaaattcaaaagcgaaagaatgaccaaagtaagcacgaattttgttcatcaaccatagtcgatgcgtatgatgtaagtcgtcttgtactagaattttaactggggtaactttttttgcgaacagatcatagtaatctaagatgaagtaataatttaaaaataattgttcacaattagctaataagttagtaactgattggttagaatgtttaactaactgttcctttaatttttgcataatttgatatttcctaggatgctcttctctcaactccgttatgtaggaacggttgaaaaacacgtcagaatttccataaaaaaaagtactacgttcatgaaatgctataaaattaaacattagttctaaatctgtggttcctaactggaaattaaatgttttcttaatgaccaatgccaaattcattacggcctgataggcatgcgtttgatttttctggtgtgctgatgcatagctattctcataatttggattaccatcgataattccaaatacatatataacttgatacaaaaaatataactcatcttgatttaaggtgagttctccttttttattccattgccacattaaatcaaaattaggatcgttatcaatgatttgcttcttggcaatcttcatatttagcggtgcaatctggcttcgttctaaggtaattgctagccaataagcaaattttttacgctgaagaggatctaaactaatgccgtatagctcttcaaaattagcaatatactcatcgagttttgctaattcagtattaaatggccaattattccgcatttcccgtgtggagttccaataaaagtaataataaaaactacgaatattgatttcatctccttttaattccaacttatacggtaaaaattgaattttataacgtttgaaatacgattttagtaatttagcgtatctaaaaactgttgatatactcgtaaactgactatctgcatagtcagccaatcgttggtgagggttatggtacataaaatcaattaatttgtaattgtaagaggcttgatagaatttcaaataaattgtatagataggaaaatcttcttcttttataattcgaaaatttttattatggtcgttgaataatctgattttctgatcggtcgacttgaataactgcttaaattcttccaaataatttaaaattgatttatccgttacaccgattacttttgctaattctttagtagaacaccatgccccgctttctagtagataatctaataaaaccactttttttaaagatgtggctgttaaaaacgttttcattttatacctcacataagatttaaatttactacaaataagctaaactttgtcagctaaaaagtttttaagtagatttctttaaatatttccaaaatgaactattttgtagctatttatatcatatccgttctaaaaaatacatatttaactcagaggtatgctagtaagaactcatcagtcaagttagtgttaattatctttaaattacgctatgcttaaattaaaaatggggggcgtctgtatgcgattatggcatgaaaaactaatttccaaactaccacgtgcccagcttttaggacagcatcgagaaattgcagccttacgaggtaacggttggggtaaaaaacatgcaaccgttgattatgtttttactcattctccttacaaactttatcaatttcatcgattagtattagctgagatgcagtcacgaggttatcatcctaaccctaaatggtttgaaccaactttccgtggtttccattgtccgccttatttagcattatgtgcttgcccactaacttccccaatctatccagaacatgatcaacagtatttggtggaatgtttggaaaatttagggtctaaaggggttcgattataagccaaacacccgacgggttctaataatatatttataataaaaggccaattcttacgaattggtctttttaagaattatcttttaattacatattcgttctctaatcccttacttaccaaaattttcagcaataatcgtcttggacttaactaaacgggccttattattactaaaatcttgggttaaatatgcataatagagtaaatcaaccacgtacaattgagctaacaatgacgtggtagcagcagtccgtaacactccactttcaccaccgtcatcgtgcgttaacgtaacagtactattttttgcgatagtactgttacgttcatgcgtaatagcgattattggtatgtttagcgaactagctactctggttatgtggcaactttccttggtctcacctgaatctgaaacaacaattaatactgaattaggtttggctaatccgaccgccattagatgtgtatctaacgtttggatgacagactttccaattcgaataaatttttgttgaaaatcctctgccactaaattagatgcgcccatcccaaatacgtagatatcatctgcttgctcaacaatatcggttgctttttttacatcatttttaagtaatatttggttggtttgtccgattgcatgacttattcgaaactccagcttatgtttcataacatccaagtcatccgatggattaacttcggtatacaaggaatcatctacctttatttctgacgcaacttgaatctttaaacctggcaaaccactcttacaaattttttttgctaacctaactacagtcgccggacttacttgagttcgatcagaaatttcttcggcgttcatctgaatcacctctcgcggataatcgatcataaatcgggctactttctgctcagatcttgaaaatttttcaaaatcgttactcaatgtaaataaaatatttttcataaaactttgaactcccacatatttgtcagttttaacattagctcctaattataaattatagtaatatatccaaaaagaccggaaaatatccgatcttctaaatttgaatacttagttaatatagttattttatcctactatccattaatacggtattatctttagtctgtatatttgattcaatttcgtcaatcttaaaatcggatgtgttagtaacaatcgtcattgtaactggatcaaaatcagcgtcaataattttttgccaatcaactgtacccaatacatctccatgtttaacagtatcgcccacttgaatatttaaattaaaatacttgccatttaacttaacagtatcgacccccatatgaactaggacttcttcaccaattttatccataaaaccgattgcatgttttgtgtctgctatcatagtaactttcccatctaccggggcatagattttagaattaatatcaggtattatagctactgtttttcccattacttcctgggccatcattggatcacttactgtatcgattgcaactttcttaccaataacaggagccgttatcgtagtcattacaacatttgaatcaattaccttcttatttccattttgggataaagcatctgtctcaacagttgttgcttctccaagaattgcatcctttggaattccaaagaaatatgttgctacaaatccaccaacgtatcctgctaataatcccagcacataagacatcatatgtccattcgtaatcaaaggaactaacgctaatcctgatgggcctatggcaatggcaccaacatggcctaatccaccaacgacagctcccccaattccgccaccaatacaagctgtgataaacggacgacctaatggtaaagtaacaccatatattaatggttctccgatacctaaaataccaactggaagagcacctttaatcatatttgtaagctgtttatttttacgacatctgagccaaagtgcaatcgcagctccaacttgtccagcacctgccatagctaaaattggtaataatggggtcgaaccagttttattaatcatttcaatatgaatcggcgttaagatttgatgaagcccaaacataaccatcggcaagaatagtgctcctaaaacgaatccagaaaatgctccgccgacatttagaatccaattaatagctccaactaacgaacttgaaataacaccagctataggcataataataaaaattgtaaatactccaattataagtaaagaaagtgctggagttactataatgtcaattgcatccggaacccatttatgtaactttttttcaattaaagaaagtaaccaaacggcaaatattacaccgataattcctccttgaccagcgctcattggttgaccattaaaaatattatgcaaaggtgcattaatatccattccaggtaataaagttaccgcacctatgacgccgcctaatccagctgttgcaccaaattcagttgccgcgttaattccgacataaattgctaaatatgaaaacacaccattttgaatgaatttcaaaattgcgacaaaatcagtatagcttttacttatatctccagcaacaattaaattagacattaccgcagctacaccaccaattaatccagctccgacaaacgctggaattaacggtatgaaaatattcgaaatggattttaaaattcgcttaatgggagtttgtttttgcttagctttttgtgcagcctttactttagcagccttagcctcaacgatttctttatcagtcataccggttgtatctatttctatattaggaaatgactcacccaatttaactccagcttctttcaccatttcatcagccactttatttacagttcctggcccgacaattacttggagggtgtcttcttcaacgactcctaataccccattaatatttttcagtttcttgatatctactttgtcatcatttctaatggtcattcggacacgagtcatacaatgaattaatttttcaacattttcgataccaccaactgcgccgtaaatttcacgtgcaattcttttaattttttcttcagatgtttctgacataagttctcacccccactttatattgtctttctaacaaaaccttttgctacctgtagcctcttttttgcttcatttaagtcaacattagttaagatcataacaatagccaacttcacatctttacccgccttttcaaacatatcattcgctactgtataactgacatccgttgctcccataataatatgttttgaacgttccactaatttagcattggtgggtttcacatctaccatcaagttcttataaacttttccaatcccaaccattgaggctgtagataacatgtttaacacaagtttttgggctgtccctgattttaaacgcgttgaaccggttaaaacctcagggcctactgctatttcaatgttaatatcagcatgtttactaattttagcgtgatcattacaagctagactaatcgttgctgcaccaacctttttggcataatctaatccaccaatgacatatggtgttcgtccacttgcagcaattccaacgacaatatctttattagttaagttttgagattgtaaatccctagcacctagctctagtgaatcttcagctccttctacagcaattgtcatagctttcattccacctgcaatcaaaccttgaaccatcttaggatttattccaaaagttggtacacactctgcagcatctagaacacctagccgaccacttgtcccagcaccaatgtagaataaacgcccttttttgttaaagctaaggataatctgttcgacagcttgtgtaatatctggtaacaccttaccaactctttgagctaccttttgatcttcagaattcattatttttaatatttctgctgtagatagctcgtctaaattcatagtttcctcattacgagtttccgttgttaaatcacttaaatcaatcatgctgctcctccttgtatacgctttcatttacagttacattttataataaaagaaataacatttcaaataaatattttattattctatttttaagaaatttaatttcttaaagctgttaaaagtactaacatattaattaattttgatattcattttttaaatatcacaacctacccccttctaaacttgcaaatatgatagtgtacagaagttctcccccctcatatactttagtttgttaaatcaaacttactaaaaatatttggaggtaaagttatgactgttgatgttacgaaagaaatgcaatttagtgatgcttttgcatatattgatgatggtgtagaacatggtgtccttagcccatttgaaaccaaagaattaatcctaaagaaaggcgaaaaaatcgccgaaggatttaaaccacttgatactgatatcaaaatgttaaaagatatccctgttaaattacgagatggagtaaccatctataccgatatttatttaccaattacaaatgacaaagttcctaccttaattgcttggagcccttatggtaaaagcgctggaactgcaccaagatataaaaatctttttaacatgcttggaatgggtaatcaatggaattctggattgactaaatttgaggcacctgatccagcctattggactcgtcatggatatgcagtggctaaacccagatatgcgtggaatcgctcatagcgaaggaaatacaacgatgcttggttcacaagaagctcaggatggttacgatttaattgaatggatcgcccaacaagattggtccaacggtaagacggccctaactggtacttcctatttagcttggtcacaatggtttattgctgctgaaagaccaccacatttaactgcaattaatcctaccgaaggtttatcagatgcatatcgtgacttggcctttatcggaggaattcccgacaaaaactttattgaacgcttagccgtaaatcatgtcagtgcaaatgatgccaaatgtgaggatttagctaaagaaatggatgctgatccgttagttacggctcccgtttggcaagacaaaattgcagataccagcaaaattgaagtccccgcttttgtgattggcagttattccaacacattgcataccatgggaacattccgagcttggcgcaccttaggatctaaagataaatggctcagaattcatgatcgtcaagaatggccttattattacgataaaaataatacggaagaacttcgtcgtttctttgaccactatttacttggcaaagataatggatgggaaaatacagctcctgttcgctacactaccattggttttcaaggcaaaaatgaaacagatattctagcaactagctttccaccagctggtgtgaataaccaaccattttatctcaatcccttaactcggactttgcaagaaaaacctttgtcacaggctgctacagtgcagtatgtagctaacgacaatcctgggcgtgtctcatttttaactactttcgatgcgccggtcacgatggtcggttatcctagggcaaagctattcatggaagtcgacgattacgatgatatggatatctttatcatggtacaaaaattagacaaatacagtaatgtgttaagtgagttcgttgtacctaatcacggtgcagccctccaagactttactcaagaaggtgcctcggccctacgttataaaggagtctggggccgtctacgagcttcaatgcgtcatttagatgataagatgagcacggatgagattcctgcatattcatttgatcgcgttgaaaagttggcaccaaaagaaattgtccaattagatgttgttttaagcccaatggggatgacttttactcctggcgaatcgttacgttttgtaatcagttccaagaatgaattaggttctgttatgccagggactcctggtgctacccctgacaatcaaggtatccatatccttcatactggtggcaaatatgattcctatttacaattacctatcttaaaaaaatagaaaagaatttagttgcttaactaaaggatttgtagtattaatgactataaatcctttttttgattggagtcacaatgaatttaacaacattagaatacttcgttcaagtagcaacagaaggaagcctaactaaagctgctgataaactttttatttctcaacctactttaagccgtcacatgaaaaatttggaagctgaattaaatactcaactatttgttcgtcaaagtcattctctaaaactcaccgaaaatgggattacttttttaaaagctacgacaaaagtaatccaagacgtagatgcattaaaacatttctttgatcaacaccaaacagctagcaatccaactcactaccttaatgtgggctatttagaaaattttcgtttagaaaaaatgtatgcagtcctggaccaaattagtcatgagaataatattcagttctcgctctttccagacaccccaactaatttatccaaaggtttatcttctggtaaatatgacttgatttactctttaagaccctataccactgacaatgtattgtttaaaagcacggattttttagaaaatcatcttcagattgcattaccaattaatcatcctttagccatgaaaccacaaccttcgttttccgatttaaaaaatgaaacttttattttattagatcgagataaatcaccaattattgtcgacaatgtgttaagtcaaggaatcaaaaatggctacaatttaaaagcaaattattatgttaaaaatttaagtcagggactttcaatgacagcattgggaaatggattagccttcctatattctgcaatgaatgacggccaattggaaaaacaataccatataaaaattaaagatttaaccgataattttggtaatcaaaatattgtgatcgcaatgaaacgttccgtagataatgcattgattggatctattttcgaaaaaataatcgatactaaaaaaaatagataagctagttaactagcttatctatttttgtattttcacaataaaaagtcatgctctagctctaaaaggtttagttatttatgaaaactcttacttcctaaaccattcgtttctgactggcaaaaactttaatatctgaattttctcattcccataacgaacttttatttttaaaatatgatccatccttcgattggaaacctctaagtattcattttttcctaaaatattattttcttcttttttaataccagattaaatgttaactttccgtgatactaattttgctgatctagctgttttagtttctctcagacataatagtattttgatcagcaatctttctaaagattaagaatttcgctactcacaaaaaaacttattacatttgttaattatctctaaaaaaactgagactaaacaacataataagcttttttaatccaattggtttcgggctgcgttgatttttttcaatacactaacggtgattctaatatcttgttcagtgaattgatctagtgcttgttctaagcgtcgttctagttcttgatgaaattggtgatgaacagcctctacttcccgacctagattggtaagccgcaaatacgtatccttttgatttcctttcatatgatatttttcaacaaatccatattcaacaagtcgattgaccagtttagatatggccccttgagtcatatttatataccgcaataaatcattaatttttaaattataatcggcgatccatgcaatcacatctagttctataatggaaagtttattcaggttctctatatcattgtggctgccaattaattctttaatggccctttcattagaatgttcgcggtaattttttagttccttagctagttcttcattcatttatattcctcgacatatatattgactttataaattttggtgctatattaaatatattccaaagaatataaaagcacaagaaaagagcatattatgaaaaaaataacaattgtttttgatcacccatatggaaaagaagctggttacaatgaaccacataaccgttcttttacttctgctctactagttgctgtgatacaggcgttagaaaaacaaagcgctcaagtagatttaattgacctacaccaagatcaatttaatcctgtaatgactaaaactgatttacttaattggcgaactcaccctttcgttgacactcaaagtcaaaactacttcgaaaggctccaaaattcagatgaaatcattatgttatttccaatttggtgggaaatgatgcctgcaatgaccaaggggtttattgatgaggtatttgccaaaggacaaatccaagaacatcgtggtattacgcgacgactattttcatcgaacaccaaagttagagttcttacggtatctggtgctccaacctggatatacaaagttctctatgggaatcctgttggtcgcatgttaaaacgtggcgtttttagaaagtctggtgttaaaaattttaaatggcataattttaatgccgaagacgtttctcctaaggctcgtgctaaaatgcttagttcagtaactaaatatatttaaattacctttttcccaattaaagactaaattatttttgatcaatattaagttttgatattggaaaataaaactcctattcatttattaataaataggagtttttatgtgtcactaaaaatttctatatttaatgttcaatagtcactacaccataagtttctatttcttaggtttacttcctttttaaaattgtgattatcgtagatagaattaatagcggtactagtaaaaaatatacaaatttgtttgatttcttctctccagtttgaggaagtttttgatattttttaattgcacgcttttgatggactgagttttgcttttttattttatcacctgattttatcagcgtatttagtttaaacttggttttatgtgttgactcaactttctgcctgtcatgatgaggtttaaggcttatttttttgtgtgactcttttcagtgttaatccttacctctcgatttgggtgaatcacccttactagaattattttaatttgtttaaacttctttggagaattgccaccaaccacctcattttgtttgttggcttgatataccaccgttttttcaacgtcttgatggtaactattaatattattaatcgccctaacaatctcagggattggtgtatatccctctatgattggtgaaaccacactcctaaaattagtaccgtcaaccgcttgccatactccataatatttttgacccgtgacctgatcaatttttacaattcgtctaaaactaagtttatttttatatgttggcttagctaattggccgtcatcatattgataataaattacttcttttaccgcacgttgttcaaaatccattttttctccatgttttagatgtacttcatacatttttattagcttatcttggtcgtaaaacaccccattttggggataatcatcactaaccaactcgtaggctgcccacttatattgattaatcgcatcgactgttcgataactatctcgagtgcgataagctccatttagtcctttttcgcttaatttttttcgagttgtatcatcatagtatgttacttgagctttttcgtcgttaattttgtatactaccgtttcttctatatctttatggctgccatcaatgttattgatcgtttcaattgactcaagagctggcgtataaccaataattttcggagaatctacttttttaaagtacgttccatcaattgcttgccaatttccatagcgtttctgctttgttacttgatcaaactcgataattcgtttgaaatcaagttcgttttcatatattggtccagcaggttgaccgttatcatatagataatgaatcacttcccttacagtacttttttctggttgcttaatgattttatgttttaaatgaatttcatacactcgaactaatttatcttgactatattttgctccattcttaggatagttatcactcaccaactcataacccatttgtttataatgctgaattgtattagccgttcgataaacatctcgactaccataagcaccatgtagaaattgctcacttaacgttcgccctgtcgtatcatcgaaatatttcacttgagctttttcatcgttagctttgtaaactactattttttcgatatttttatgattttcgttaatattaataatttcatcgatcaattttggtacagcggtatagccttttatatacggagaaactactcttttaaaactagttccatcaaccgcctgccaattcttataatttctttgttttgtaacttgatcagtttctaccttccgttcaaaattaagtacattttggtatatcggtttggctaattgaccattatcatagcgataatgaacggtctctttcacattccgtttttcaaaatcagactctattccatgcttaaaatgaacttcgtatatttgatcggttctatcgtcagtatcaaaagtagttcccgttacaaaattatcactaactaattgataaccttgttttaaataatcttggatgtctgctcttgtagagtacttcatcgttttaccaccctggccagttagtacatggactctcatgttagttccagtattatcgtcaatatacttaataaatgctttttgaattgacgtatatttcatggagtcaattttaaaaaattgtttagtaggtaatacgcctgtggatgaagcgatagtaaagtaatagacgggatctttagcatcataatcaaattttttcttaaaaataacatcccccgttggggtcgaaaggatcaccttaaattctttcgtacgagctgtatatatcatttttatagcgtggtatttattatcttcgataatttttggtaaaggccgtacactgtctttatcaatggtcccttgaccatttttattagtagttaccatcgcaccatatggatcgggaaaagcatcatcagcttcaccctgtaagcgcctggtagtgttaccaaacttaaacgatctacccacgttatgccatgtgtcagctttccatccaaaagcattagtcactccatagatacccaaattcccaccgcttctgccaatttggttacgggttcctttgtaaaaaacgatcccaattccgtctgcgattccctttataactctaaaaacattccttactttcgtttcttttcctaaattaattgcaccatcaattctaaaattgtgcctaaggtctattccacctttaaaagtgatattgccactttgccatgaacctgtagtaagcttttgctcaccggttattggattgtagttacctttggcactcccgttctgattaaaataatctttaaaattatctttgtttacatacacattatcctgtaaatctgttttatcatttggtttcactttaatttcactgtttataaaatttatatttttaatagtaccttgattttcattacttttcttaggagttattagagctctgttcttcacttttgtattttttagtgaccaatcgtccttaatagtttttggatcgacaatccgattttgattttttttaagtagccttgaagcttggttactatctgctcttttattagtatcattggattttgatgcttgactatgagtctctgtttttacatcaacacccacttccttagtggttttaccattcttagttagctctaataactgatttgtttttaaagaattagcatttttataagtattcacttttccaatctcggaagcctgagctacatctgcatgctgtagataactaataccaagtcctaacatagctaaattgatcaatgttaagatcctcttaggttcgagacgtggacaatatttctttttattgaacgttttaccaaactttgcagtcaatctaagtcactccaatttaattttaaatttaaaaacattattcattactaatcgcattattctaaacaaatgcgtctatggctatcctcccctcattaaaggtttaaaatttcataatgtgcttctgattttaatttagggtattaactgattgtaactatatttctttttaggatattatggcccttaaacgggacatattttttatatctaaagattatctgcataatttaactggggggattagtatggaatatgttcttaaggtaatgtctttagcaaactgttgcataccccattcgtcatctttaccagcattttgtccaacttcatgtgcgatatcaatcatcatcggagttcgaacaattcccggtgcataagcattaactgtaataccaaaatccgccaaatcacgtgctgctacttgagtaattcctcggacagcaaacttagtccctgagtaaagggccaaattagggtttccaacaactccggcttgagaagtcgcattgatgatttttccaccatgtcctaatttcttaaatgcttccgttgctgcttgaattccccaaagtactccacctacattaacgtgataaactttatcaaattgttctggtgtaattgtatcaattggtgtggtaggtcctaggccggcattattgaccaacacatcaagtccacctagttcctgaatcgtagtcctaacggcttcaaacacattatcacgttctactacattaaccacgattggaagagcccttccaccgttgctattaattttttcagcaactttgttagcagtttcagtattcatatctgccactgccaccgcaaatccatcgttagccaatcgggtcgcaattgctgccccaattccttgtcctgctcccgttactaatgcaactttggttttgtttgccatcatctttcgcctctttgaactattttattatttattttgcatccgcttgggccaccgccgtcattgctaacgcattaatataatttaacggttggtcgtagttaggttggaagaacatatcaaccatggataagtcatcaatcgtcatcttattttgaatagctaatgaaattacattagctgattgagcacagtcatattcgctatagaatgatccacctagaaccactcgtgtttctgggtcccaaactaaccgcattaggattggggtcgttgaaagcataaattcgggacggtagtcttgttctaaggttacagagtctacttctacaccccgtgctttagccgcaccaacagttaatcctgaacttgccatcgtcttaccaaagagtgctactgccgagcttgcttgtgtaccaagatatttcatcgttggtttttcaatgttatgtccaatcaaaattccttgacgaactgcattagttgctaatggaatgtaatcatcttttccagttggattataatgaacaacggatgaatcccctgctgcaaaaatatcagggttcgaagtttgcatgtattcattagtaataattgctccgttcttcaacatatccactttgcccttcaataattctgtatgtgggcggaaaccaacgcaaagtacagcatagtcggccgtgtaactgcctttatcggtttttacagtaatctgatcatcaccactaaatccttgaaccatttcgttcatggccaatttaactccgtgatcagtgtaatctttagctactcgatcagagatttcaggatcaaaattcttagctaaaacacttggtaatccatcaatcaaggttacttcgcggccagtcaaggcatattgttcagcaagttccgctccaatataacctgcaccaattacaattactgagttaatgtcaccatcaattcgttttaattccgcagcatgagcccaatttttgcaaagtttaactcgtttattatcgattccatcaatcggaggaataataggtgctgaaccagtagttaccaccaatttatcgtaagtatctgttttaatttcaccggtttttaaatcttttacttctaaagttttattatcggggtcgatactaagtacatcatgttccatattcatagtagcacccaacttagttagggcttccggtgatgaatagaacattttattaggatctgaaacgtggttacctacccaaagggcgattccacaagataaaaatgacaaattattattacgttcgtataccgttacttcataatcggggtgctcagttaaaatttgttgcgctgagaaggtacctgcatgtgtacaacctacaattgctattttcataattaactaacctcctatttgtctatatctaattattaagcgctttcattgctttgtcaacttaactctggtcctttagaacaaaaaaatgaaacaataatcgtcaagtaccgattatcgtttcattagtttaaatttcatgactgatttcaggatgataaactaatttactagttttttcaccaagttgctctagcaggtagacaactgggatttgcgatgtaaaattcaacgatcctactttattttcgggaatatcataagttaaactatagtccgcaatctgcgccaacgttgaagcactattagcagtaattgctacaatttttgccccattttggcgataataattggcctgcgttaaaacaccttcagtttcgccagagactgatagtaaaataatcaatgttttagaatagtcgcgttccgagatgggttgaggttggaaaggatcggtaatggccaatgtgagcatcccataattcgataaaattcgtgctccatattgtgccatactaccacttgatcccattccaaagaacaaacgggtgttggattgtgcaaccacgcgagcaacttcttccattttttcggtatattctgttgtagcagtctgttttagaaattgacctattggacctaagtcttggctcaattcactagcaggagtttgatcatttcgatggcgtaaaacatacttaaaatcagaaaaaccctcaaatcccattttcttcaaaaatcttaaaatggtcgtagaagatacgtgactctgcgtggataaatctcgaatagtcatggttttacactcttctagatgactagttacgtatttatacacaaacaattccaattgattcaacgtttgaactttttcataactaaacatcaacatcacctctttaaaacttgattattcttaaacaacttactataaatcttcaccattagatgcaattacttgtttgtaccaatcaaatgaatccttcttcgaacgttctagactaccattaccctggtcatcttgatcaacatagataaatccataacgtttagccatttctccagtacttgctgaaattaaatcgatgcacccccatggagtataaccaattaagttgaccccatctaaggcaactgctttttccatctctaaaatatgatcgtggaaatacttgatgcggtaatcatcatggacagcgccatcggcttctttttggtcgtatgctccaaaaccattttccacaataaattgaggtttgtgccaacgatcttgcatccaattcatcgaataacgtagaccaacaggatcaatctgccagccccaatctgatttttgaacataaggattgtcgactaaatcacgtgcttctttataggcatagtcggtattttcatccgtagatttagttgtaaatgacatatagtaactaaatccaatataatcaactgcaccctttttcaaaatttcacggtcttcatcactaatttcaacatggatgttttggcgttcccaatatttaggaagccaattagggtattcaccattagcttgaacgtctccaaagtagtaacgcgtttgcatagcacgttcagccatcatgatgtcttctggcttagcagttagtggataaattggacacattgcaatcattgctccaatttgatattccgaatcaatttgatggcctagttcaactactttagcacttgcaaccatttcgttatgagcggcttgatacatcatttcttccattcctggtgttccagctttaaccttaatggctgaatcttgaagtaaatgatgaggattactccaatcagtttgattattaatctcgttgaaggtcatccagtacttaacttttcccttatagcgtttcatcactgtttcggcaaaacgtacgaaaaagtcaatcaatttacgattagtccaaccaccatattcttttactaaatgatatggcatttcgaagtgtgacaaagtaatgatgggttgaatattgtattttaataattcatcaaacatatcatcatagaactttaaaccagcttcgttaggttcggtttcatctccattaggaaaaattctagtccatgcaatcgaggtacggaagcatttgaaacccatttcgttaaaaagtttaatatcttcaggataacgatgataaaaatcaatcccccagtgatttgggtaaacttctccatctttaataccgtccgttacttttcgagcagtatctttgtttccagcggtcatcacgtctgcaatgctaactcccttaccgccttcttgccatccgccttcaaattgatgagcggctactgcaccgccccacaagaaattttccggcatcttataatgcttttcagtcatgcttaaaacctcactttatttttcggccatttttttatataaatcaacaatttctccagctagatctctaaaagtaatggcgttcatgatatggtcttgtgaatgaaccgttagtagtgaaactttagcatggtttcccttagcttcttcagttaacatcccggtttggacgttatgagcttcagtcaaaaaaccatcagattcttttaatttttcatctgctttttcaaagtctcctgctttagcagcgttgatagcttcaaatgcagagctctttgcgttcccaccattaataattagtcccatgatcacttctagattttgttcttgttcacccattgttatgctccttaaatttatttatataaaaaagcgcctcaaaaaacgaaagcgctttaattcaaagcccaattaaacctatacacccattgatgttagagcttccttcaatactttttcaccattcatcatgccgtaatcttgcatgttaattacttctactggaatatctaatttttctttgaaattaccttcaaggtaacgaacttgaggtccaagcattaaaatatcaggattcttttcagccaatttattatctgcatctgatgcagctgttgcgaagatttctgcatctacaccttcagcttcagcggctttttgcattttcgaaactaataaacttgttgacatacctgcagcacatactaacataattgttttttcagccataacgagtcacttctgtaattttatttaatttggcggttgactatgaaaccgcttacgatacaattgaattataaaacgtaggtacaaattttacaagtaccaataattcaaattcgttaaaaagttatcaattagcgttactgataaggaaagaaggcgttcatcgttgtatacgaatatcgcaaatgatctcattgacaaaattaaacatcacctatttgaagaaaaattaccaactgaatacgaattgatgcaagaatatgatgttagtcgtaataccatccgcaaagcagtcgatattcttagtcaaaagggactcgttcgccgtgttcaaggtagtggctactatatcaacgattttggaccacgagctgatcaaaccattaacctaaccatgggagtttcagaaggctttaatcatcccaaactaacctcacgcgttatcactttcgatcgggtggtagctgatgaggctcttgcagctgaatttgggtgcttagtcggcgatgatttgtatcgagtaattcgttatcgttttcgtaatcgtcaagcatatacccttgaatatgcttattacgaacgcgaagaggtcccctttttaccaatcgaagctgcgcatgattccttattagaattcattagaaatgagtatggtgtatccgtcgatactagcgaccaatacgttggaattgaatctttcacttcggaagctgctttcattactgggctccctcaaggtgataaatatattgttttatatcaatcacattatcgtaaaaataatgtgttgtttaatttctctaaaacttattatttagaccgcaaaattcgattttatttccacgcttctaatcaaagctaaaccaacggattattttaaattaaatttttagttgacaaacgaaaagtattttagatatactcatggaagattaattcaaaagttggtaatacaaatgagtcttttacattcaacacatgtaaataatggttggcaaagccggtaattaggttgtaattttgtctaggcaagatacgacctgaatgacagatcgtatctgtgccggctcatttgtgacgaacaaacgataacaacaagcccgcatggattttatacacatccatgtgggctttttttaggcaaaccccatgggcttgctttttttattataaatttagaggagtggaacttgttatgaagagaatgcttagctttatcgccattatttttatttttttaggatatgcatttgttgctgaacaaaagcatacctcgaaccatcgaaatgagactaaacgcattggtttattacaatatatggatcagccagcgttaaaacaaattcaaaagggagtttatgctggtctaaaagagtccggttatacagtcggaaaaaatctcaaagttgattatcaaaatgctcaaggtaatcaaagcaacttgaagacgatgagtgaaaaattcgaaaatgaaggagttgatttatcaatcgggattaccactcccgcctcaatttccttggctaatacaacttcgactacccccattttaatgagtggagttaccgatccacgaagtgcttccttggtacaaaatttaaagcaccctgaaaaaaacatcacgggagtttccgatcaagcaccactagaagaacaattagaattaatccaaaaattaatgccaaatttaaaaacattaggaattatctacacatctagtgataattctgcaattactcaatttaaaaaattcaaacagctggtatctaagactggaattaaacttaaggcttattcaatttcaaactcgaatgacttaaaccaagtttcgcaaaatatggttcaaaatgttgatgctgtcttcgttcctactgataatacgatcgccggtgctacgtcaaccctcgttaagaatgctaatgctgccaacgtccccatctttccaaccgttgattctatggttaaagatggtggaattgccacctacagtgttaatcaatatcaactcggagtccttactggtaaaatggctgctcgcgtcttaaacggcgaaaaaattaatcagacacccattgaatttatcaagcatggtgacttaaccattaaccttaaacaagctcaaaaactaggtatcaagattcctaaagatttaatgcaagaagcacaaaagaaaggggaattaatcaaatgaacttaatcacatcttctattggacaagggctactctggggccttctaggggtaggactatttctcacctttagaattttagattttcctgatatgacggttgaaggaacttttccacttggcgcagccgttagcgttactgccatcactaacggactcaatccactgatcgcgacattacttgcttttctagctggtatgcttgctgggctaattactggcctcctttacaccaaaggccgtattccaatcctattagccggcattttagttatgacggcttgttactccattaatttgcggattatgggaacttctaacgtttcactcctaggaaaacaaaccttattcagtgggcaattctttgcgtcactacctaaattttttgatagcgtagtccttggactgatcattattaccattgttgtagctatactggccatctttttacaaactaatcttgggcaagcttttattgccacaggtgataatgaaaaaatggcgaaatccttagggatcaataccgatcaaatgaaaaatatgggacttatggtttcaaacggtatgattgcagtatctggtgcactcatcgctcaaagtgatggatacgcagatgttaatatggggattggaattatcgtaattggcttggcttccattattattggagaagtagtttttggtgaattaaccatgaatcaacgtttagtagccgtagtatgtggaagtattatttatcgtttcgtcctcctactggtactcaaggctggattcaatactaacgatttaaaccttatctcatcgttggtcttagcactctgcttaatgctgccaacgttacgaaaaaaatttcattttgaccgaattttaaaacatggggttaccatgccaactaaggagcgtgattaaaatggaacgacctgttattttagaacttaaaaatgtctcagtctatgttaatcgccacacgactgaagaaattcaaattttgaaaaacattaatctaaaagtctataagaacgacttcatcacccttttgggttccaacggtgccggaaagtctactttattcaatgtcattgccggtaatcaacccatcgatgaaggacagattttggtaaatggtcacgatgtttctaatatgtctgaagaaaaaagaactaaatttattagtcgcgtttttcaagatccaaaacttggcactgcccctcgcatgacggtagccgaaaatcttttacttgctactaaacgaggcagccgccgaaaccttaaattgcgccgtttaaagcagcatctcgctgagtttaagcaaattactgcaacgatgcctaaccgtttaagcgaacgtcttaaaacacctactggtaacctatctggtggtcaaagacaagccttaagtttcttgatggctaccattaagaaaccagctattttactattagatgaacatactgctgccctggatcccaagactagtgccgagttaatggaagcaacgcaaactcgagttactgaagacgaattaactgccctcatgattactcatcaactttctgatgctgtaacctatggcaatcgattactagtaatgaaagacggacgaattactcaagacttagatgccgttacaaaagctaatactaatattgatgaattaatgatttattaatattaactaagcaaacaaattccataggagtttgtttgcttttttgttcatattgtatatgctttataggggttattttcaaccctataaaaacgtttaacttgcgattatatcaacgattgtaaacggatacattacgtgttaatattagctcgtaagtaagaaaatacataagaagaaggcgtttaaaatgaaagaaaattttgatttccttatgcctagtgtcaacttcttcggctctggagttattgcaaagattggtgaccgcgctaagatggtcaatatgtctaaagtattgatcgttactgataaatttttggaaaaaatggaaaatggacccgttgaacaaacccttcgttcacttgatcaagcgggtgtcgattacgttatttacaacggagtagagcctaatcctaaagttagaaatatccaagaagcaaaacaagtttatttggataatggctgtgatggaattatcactattggtggtggttcagctcatgatgctggaaaaggtactggtattattttgacgaatggcgacgatatcaccaaacttgctggaatcgaaacgctcgaaagtgcacttccaccattgatcgcggttaatactactgcaggaactgcttcagaattaactcgtcactgcgttattaccaacgaagaaacgcatcttaagttcgtagtggtttcgtggcgtaatgttcccctcgtatcatttaatgatccaaaattgatgctcggggttccacctgctctaactgctgcaactgggatggacacatttgtccaagccattgaaccttacgtttctactaaccgcaacgatattactgatggtcaatgtctccaagctatcaagttagtggaagaaagccttcgtgaagctgtatctaacggtgaaaacctagaagctagaactaagatggtagaagctgaaatgttgggagggatggctttcaataatgccgatcttggttacgtacatgctatggcccatcaattaggtggacaatacgacgctcctcatggagtttgttgtgctatcctattaccaattgtagaacgcttcaacttagttgcttgccctgatcgtttcgcagacttagctgtcgccatgggtgaaaatatcgacggcctttccattagagctgccgctgataaagctattgatgccatgcaacaacttaacgacgatgttggtattccaagaagtatcaaagatttgggtgctgatcctaaagatttcgaactaatggctgaaaatgctttgaaggatggtaatgccttctccaacccacgcaaagctactaagcaacaaattgtggaacttttccaacaagcttacgacgcaaaataattactcaacaaaaaaagatgaactgagatttctgattcagaattcacgttcatcttttttatttatttggcaacttttttattacttttaacactaaaggaaagaattaatcctacgataattaatgcaatcgtaaagtagaaaccatagtgtgtaccattagtgaaggcagcattcaaatgacctttaccaaaatgattctgataagctgcttgtccgattcctaataaacttgttgctaaagcagttgcaatcgcaccaacgatttgttgcatggtattcatgatcgtactaccgtcacccgattggggaccttcaagcgaatttaaagcatatgtttgagctggtgacattgccaaaggacaaccaatcatcaaaataacatgagcaataattaaataagcaattgaagtatttaccgtagtacataccaacataattgcaccaattaatgcaatcactagtccaatacgaattggtgctttggcaccgatcttgtcgtataaacgtcctgcaaccgctgaaacagcggcattaattacaccaccaggaagcatgataattccagttagtgcaactggtaataataaacctttttgaatgtacattggtaataggtacattgctgataaaataataccaaaatcaagcataactaagattgcaccagttctaaatgcaggaatggcaaaaatctttaagtttaggacaggttcagcaagcgaaagttgacgtttgacataaaatgccaaaacgataattccaagtgctaagatacctaatacgattggcgaaccccagcctttttcactagcaaaactgacaccagttactatactagcaaagccgataattgattcaatcaatgaaattacatcaactttaggtttagtaagttcaccaacatcttttaatccaaaaatagctagtaacaaagcaattgctaagaaaggaacgaacatccaaaaaatccagttccatgataacttagctaaaataatacctgtcaatgtcggtccaatggctggagcaaacataattaccaaagcacacatgcccattgcagcacctaatttataaggtggaaatactaacatggctacggtaaacatcataggtaaaattaaaccagtagcgattccttgaatcattcgaccaaccagtaataatgcaaaggttgatgatagagctgaaataacagaacctacaataaacgctaataaaccaaaaataataatctgtctagttgtaaaccattttgatattaaactagaaaagggcaatactacaccaatcacaagcatgtatcccgtaactaaccattggatagtacccgtcgtcacatgtaaattgtccatcaattgtggtaaagcgatgtttaaagatgtctcactaaacattcccacaaaggccccaatcaacatgctcgccattaccaacattggatgttcaactggtactcgcgcttgcatcatgccgttgcttttttcttcattattcattaaaaaatacctctttcttcaaaaacatagcttgttcactatagcaaaaagaaaaaattttcgtaagtatttttttgagaaaaataaaaagaggccgttctgtaaacggtctctttctgataagaatgcctgttgaaagttatctaacaactaagacagaaattggggcatgtttagccatatacgaagcttgagaaccaaaatatttggccatccctgttttagaagatgaaccaattactaacaagtccggatcaacactaggaatcacattttttacaatagtttccccggcttcgccttctgctatgtatgtttgtacttttttaatgccaaatttcaaggcaatttttcgatagttttggagatgtttttccaattcagttcgcttttgcgtaatgaaatttttatctaaagcttggtaaatattaatgtcattttcttcaattaccgtaaccaaatctaactcagaatcatcctgtttagcacgattcattgcaaaacggaatgccaactgcgcatcaggggagtcgtctacccccaccagaatcttactaaatcttttcggattaaattctcttgaactcatgattttccctccatgctaatccctattatcattttgaatatggtagattatcaagctcggttcgaactaataaaacatccatcaatgcaactcttgtaacatagtccgctaccgaaccaatcattgctcgttggaaagcgttcaaccccgttgcccccatcataatcaaatctgttcccagcttttcaggcatctctgtagcgataatggccttaggatcgccagcttccacatatacctcaacatcttcaaaatcatatttacgtttgatttggtccttcaaatcttcaacatactctttagctctacgaagggatacttcaacataatccatgttactgcccatatgtccgtacacatctaaaaaccgtgaagattgaattacagttaaaatatctaagtgagcatggttacgcttcgccacaaaaatcgcttttttcaaagctaattcgcccttaggagagccttcaactggcactaaaatcttcttatattcaagcatatccattactcctctatacgtttctgttatcattataataaattttttaagatagcgctaccaataataccttagaaaaaagcgagtccccgctcttttcatttaaaattatcttaagaagcggtgagccaccattaccatttcttggttagtctgcacaagtccatcttttatccattgtacaaccatttggtttagtcctccagccacaaaattaacccacattactgggatatccgtccgaagtttaaagattccttgttcaattaaatctgttaaataaaagtttagtttatcatacaagcgatcatttaaatcagcatgaattagggcttcaatatacgaagcattccgccgacagattgagaaaaacgcttctaaaaaggtcccaatatcatgattaggacgtaccatcagatagttaaagaagtcggtaaaaatttgatctattttataatcaataatctgatctttagttttaaagcttcggtaatacgacattctagataccgacgccgtttgacaaatattacttaccgatatactggctaagtcattatcttttaacaactcaaatagtgcatcgatgatcttctgttttgttgcttcatgattagccattattatacctcacaaaattcgaactaaatatacttcatgacaaaagcccttcaagctatttacgatatgcttggctcggcttgattttgacgcaaccccaaataccgttggtccagtcccactcatttgagctgcatctgccccgtattgtttaattcgatttttaatttttaaaacttccggatgttcttttccggttacttgctctaaaacattgcccatataacgacaaatgtctgtataatcttcacgctcaattgcatctaaaattgattcgatattagaatgttggagctctttgtgttcgattttactaaggatatacggcgtcgacacactaagtttcggtttggcaatcaccacccacataggaggtaatttttttaaaggaattactttttcaccttttcccaaaacatgtgccgtccggctatacacacaaaatggtacatcggaatcaatttctaaaccaattttagctaatacttctaagctaagctcaagattccatagtttatttaatcctcgtaaaacggcagcagcatcagacgaacctccgcctaatccagctgcaaccggaatgtgtttacgtatttctataattactttggcacgtacgtgatatttttcttgtaaaatccgggcagcttgatacgccaaattacgactatcgttaggtaaaaaaccggtattcgttcgaactttaattcccattttaccaggaatactttcgatttttacataatccgctaaatcgaccgaggtcataatcatgttccattctggtaatccatcaggatgattaaacggcgtatccaaaaataggtttaacttggctggagctttctcggtgatttccatctacttcacctgtttcgtttgcttttaacctaaattatactaaaaaatggtaaaaataaaaaaggctaatagtcataaaagcttaaatgccccaactatcgccaatttaattagatattagtcttcatcaaattcttcaacgtcatcatcatcaagctcaattgacagctcagcttggtcgatttcatcatcaaagttaacttcgatgtttcttgtcaaaatatccgtgtaactgtatgacacacgttcgaaggagttctcgtcttgatccaaatctactacgaaaacggctggatatgtcatatgcaggcggccacgacgcttagtaatctttttacgtccgatttgagcaaccaccagtaattcttccccgatgcgaccatcgagcttatccttaattgtagctagtgtgtttggcattaacttcaccttcccatgtgaaacattctatcatagtttcacaaagtttgcaattttaccacacgtacaatttaatatcaacgctttacatttcatttttttatgcttcaagcccatgaaaacggattattttcgtttaaggccttcaatttgaatccgattatgcaatttaatgaaatccagcacggttaatcgctctggtcgcacttgtggatcaatacctaaatcatccaaaacattttggattttagctttgatttccggttctttaccataaagtccctgcatattgttccaaatatttttacgacggtgcataaagcatccgtgaaccgtcttaaagaagtctttgtcgtcttctggcattacttcccagtcagcacgaggcgtaagactcacgatggctgaatcgaccttaggacgcggcacaaataccttagaagaaacatcaaattcaatttgcgtattcattcgatattgaaccactactgataaagaaccatattctttgtcgccaggttgggctgtaaggcgttctgcgacctctttttgcatcataacaaccattttatcgatgggcagggtactagccataaatgtctttaaaatgggggttgtaatgtaatatggtaagttagctaccaatttcaaacgacgttttccgtctaaatgattttcgacttcttcgtttacatttgcttttaaaacgtcttgattaaccaccgtgatattatcgtaaggactaagggtttcatctaggacgttcattaaattacgatcaatttcaaatgctaagacatgatgagcacgtttggcaatttgttcagttaaactaccaattccgggtccaacttcaattacgtcatcctcaggagatacttccgcagcatccacaatatttaaaagtacgttagggtcagtcagaaagttttgtcctagacttttcttagctgataatccatatttttccaagatagctcgagttcgagttggattaccaatatccatttgattattcattaattcctccattaatttgttctacagcatgattaaaatctgatttttcaacttggaacagttgtaaccttttaggtagttgtttggcatttacgtatccaatccctagtaaatctcccaaacgaattcgccgttgttttgccgctgaacccgcaattaatccagcatcaatcaaatcactctgagtaatttgcggtgcagcatcctcatcttccgtgtaaagatgctcaagtgattggcggattacctccggagtggcatgttcgactcctaagcttcccttgtgatccggaacagcatcttttcgtttcaaaaaagcatgcttaacgttaggaacttcggctgaaatagttttacgaatcttttcgccagagaaatctggatctgtaaacacaattactccgcgactctcttgcaattggcgaatttgttcgatggtttcatcagataacgctgatcccctagtttccaaggtatcagcgttgacagctaggttgattcttttagtatcatcttttccttctactacaatgacttctttaattttcttcatttttaatcccatataatttacaagtattatcaaaagttatttcggctaattgatcaggtgccatatcacgatgacgagctaaggcctccagaacatatagtgaaaaagccggttcattttgttttccacggagcggttctggcgctagatatggagcgtcagtttcaaccataatgcgatctaaaggcacttggcgaactgcctcatggactattttagtttttttgaaacttgccactccactaaatgaaatgttaagcccgatatccaagaacttttccatccattccacatcgccattaaaactatgcataactcccttgattttatccgcaccagcattttttaaaatcgcataagtatcttctgtagcatcccgattgtgaattgaaattggtaaattttgctcgatagctatttgaagttgttcttcaaaaacttgacgctgaaccttttgaggcgaagtatcccaatggtaatccaatccaatttcacccaaggctaccactttcgggttttggagctgttctaatagttttattcgttcagcttcgtgaaaatcttttgcgtcctctggatgccaccccacaatggcataggtatgaggatatttttcggctaactgaatagctcgttcatttaggaccgtattggaaccaacttgagcagtcgctataacacctaatttttgggcatgctcaatatacttttgttcgttgccccaaaaagcatcatcatctaaatgcgtgtgtgaatcaaaaatatgcatttttgcctccttgaatataaaaagggctgggacaaaacacctgtttcatcaccagtcccattgtgttaaatctttttaacctaaaacatcgccgttttggtgttggtcgtcgaccatcacgacttttacttggtcgtcatgttcagttgataaaatcattccttgactcatttccccacgcatcttacgtggtttcaagttagcaacaatcacaacttttttacctactaaaacgcttggatcaggatatgattgagcaattcccgaaagaatttggcgtggttctccatcaccagcatctaacttaaacttcaataacttgtcagcaccctttactggacctgcttcaagaacttcagctactcgaagttctaccttatcaaaagcttcgatccgaatttcttttttctggtctgttgccacagcttcggcctttttctggttagcttcagccattgcagcacgcccttttttcttgtctgattgagtcatttggtttttaaggaactcaacttctttttcaacatccaaacgagggaaaattggagttcccttttccacaacctttgtatcagcaggaatttcaccaaacttcaaaccttgaagttcaagttggttaacatccaagcccaattgtgcaaagattttagctggcgactgagtcattatcggttggatcaaaattgcaattacacgcaaactttcagccaaatgattcatgacacttgctaatttttgtttagattcgtcgtcatcatttcgtgcaagaatccaaggcgtagtttcatcaatatacttgtttgtacgcgcaactaatttccaaatttcagctaaagcatctgcaaaatgaaggttattcattaagtcttcatagttcttaattgtcgtagcagctgtggtttccaaatctacatcaacgtcattaacgccactttggaaagttggaataacgccgccttcatacttgttaatcattgctaccgtacgattcaaaagattacctaaatcattggctaaatcaaagttaatttttgaaatgaaatcttccggagtaaagttaccatcatttccgtaaggcatagctttcaataagtagtagcgtaaagcatccaaaccatagtttttaacaatcgtttcagggtaaattacattaccctttgacttagacattttactgtccttcatcaataaccaaccgtgaccataaatttggtcgggttgttcgaggcctaaggcgtgcaacataattggccagtaaattgtatgaaaacggacaatttcttttccaaccatatgaacattggcaggccagaatttcttaaagttaccatcttcgtcactgctataacccaatgcggtaatatagttagacaacgcatcaatccacacgtaaatgacatgtttagggtcatttttaattggaactccccacttaaaaccagttcgtgtaaccgcaagatcttctagaccaggtttgataaagttattaatcatttcattcattcggcttgccggttgaataaaattaggatgagtttggtagtaatctaataaccaatcggcatatttgctcatcttaaagaagtaagattcttccttaactaattcgacttcgtttccagaaggagcctttccaccagttacgttgccgtcagcatcacggtaaacttcagctaattgagattcagtaaagtattcttcatcagaaactgaataccaaccttcgtattcaccaaggtagatatcgccttgatctaataatttttgaaaaatcttttgaactgctttttcatgataatcatctgtggtacggatgaacttatcattagtaatttcaagtaaatcccaaagttttttgatatcctctgccatgccgtcaacatatgctttaggagtagtgtttaaagcttcagctttttgttcgatttttaaaccgtgttcgtctgttccagttaagaagaaaacgtcctttccttctaaacgttgaaagcgagcttcagcatcacaagcaattgttgtataagaattaccgatatgaagttttcccgatgggtaataaatcggcgtagtaatatagtatgtgttattttctgccattatggttcctctattctagtcaagttaattaattgtaattgtatcatattttatagcgtcaaaaacccgtctctttaacgaaaataacgatttattaatcaaaacaaatccatctgaactggacctagaccctcaaagcgaattcctaagattttttgcaactctttcgcattatcaacagcatcatggtttccattattattgaagataatggttacttcttcaactcgttcagatactgccttaacccactgtgctaactccgttaattcatccgtagaataacgataattagtgcgttctttccgccattctttgccactcataaaccatccctgagcattacgtccgtgcaaacgaaacatggcttttttagcactagtcacttgaagtaccaaaggcatcccttggttgccgtcaaacggctcatcgacaattacatttatcattttaaggcgctccaaatatgataaagtgtccgattcgactgcctctgtgaaccaactgggatttctgaactcaacactaatcggaattcgatccatcatttggcgaatttcaaataagtagcggatattagtcaaatcacatcgaaacgaaggtggaaattggaataatacagattccaactgtccattttggattaaaggctgcattacctttttaaaattagtaaattctattcgtcgttctggtgttaaatattcatcctcatcaacgtcatcgtggagggtcataacccgagaagctttaaagatgaatttaaaattatctgggacttggtgttgccaattgacgacattggacaacgatggaatcgcataaaaagaactgtccacttccacaatcggaaagtggcctacatattcttctagcgttgatttaggtttaccttcaaccgataaagctggatgatcggcccaagtgcttagtccaatctgaatcataaaatccccccattaattaaaaaaactgaaattcaaatcatctgatttgattccagtctaatttatttttatttaaaaaacactaatattgctgaaataataatcatagcaatgttaacacgcattaaaaacaaatcaatgatgcggccttccactcgattagatactaaacggattaagaaaaccatcaagcctaagtaacataataagatcatgggtggtactagtaacattccaagtaatccaattaaaaatatcaccaatccaattttttcagcctgggatagacgccgatatgcaaaagtattaaccaattggacatgcttttgctttgcaatggtcaaacgatagatatcataaaccttaactaaggcggcaataaccgtatagacgaacaagaaagtccctgctacctttccagaaggttttccactaaaaaattcaaatccaatacctgatgctagcattatcaaagtactaaaaaagaagcccacaaattcttttgtatcagaaacttgattgactaccgattcttcagcaggcgttaatttacgaacatttaatagcatatggattagtgcgtaggaaaccgctcctgccacaattaacgagaaaaataaaattgtccaaaaattaatgctacctgttaataatttaaataagaataacccaattgaaactaatgagagaattccagcaatattagctgttcgattccatcctttttcattcatagtatttaaaatctccatagtataagtacataagtaatttcaattctaccatttaatagctctcctatctagattgattcgtcataattccctttaatccacgaactgttatataatgagaacaaatgaaaaggggtgggaatgatgagaaacaaattgtataaatccagaaacgataaagttctttcaggtgtgattggtggattcgctgaagcgtacgattttgatacaacgctcttacgaattatttacactgccgtaaccctctttaccggttttttcccagggttaatcctctacattgtagccatgatggtaatgcctgaaaggtaattcttacttttaactggatgcattgaactggcatctggtttttattttgattgttcatcaggctgaaaatcacaatttcataactaacaaaaaatcctgtaactaaaattactttagtccaggatttttattttatctaatagtataaggcatcttcatttcttcaaagaagtctttaacattctttgcatataattcacggaagtattcgtcacttggcatgtctttaggtgttggtaccacaaaggcgttttgttggtcgctaattcctaatccaacaaatccgcgtgtatcttgagctttttcatgtaaatctgaatggaagatttggaataattgtttaactgataaacgaagttgacgttcactaaatacacttcccaatgtcgcaaattccatcgcatgaatttctggtaaatcccattcttttaattgagtatcaattaattcgaaagctttgactacttttcgacggaaatcaaacggattactgatggtccgttggtcaagttcttgcataatttttttagcagcttggtaggttgttggaaaagcatccatcaaccgcgtttcaaagttcgctaaaccatttccatagaacgtaatggcatccatcatcattattagacgaatagtactaaatccgtcaactttaccagcatcctcagcctctacggcatcctcaatccccttaaagaaagcttcttccacctcatcatcgattaaataatgccgacgctgttctttgacgacaacttcgtgggcgattacatcgtaaagctcagtaatcaaaaacatcaattgattgtccgtatctttttcccctgttgataattggaaataaagttgtggaaaacctttcaaaatcattaacatgtgaattaactcatgggaagcagtgtaattaggcgctgtaatatcattgatcttgattaacatcttaccttcttcaacaaattgctgggcttggtcgtgacgcacaaaaccggcctgttcttcaccaaaaccaatccgtacttctcctggaaaacttgcattaacttcttcaagaagcgattttactgtatcatttacttcaactttgctcatcattatccttctttcttagctgtttaataatttgttgggcatttttggcatcaattctttcagcttggactaatcggttaaccgcatctcctagctctgcttgagtcgctccatgttctattaaaagtgatttagcttgtagtcgcatatgtcctgattgaattccctctgacacaatagctcgcaaagcggccagattctgagctaaaccaatcgcagcaattacttccgccaattgtttagcgttcttaatttgcattaattttaagttcagctgagcttgagtattaatcccaatcgaaccaccaacggttgccactggtaatggtaattccattctgccaactagttgatcaccaactacatcccacgtactaagtccttgatattgaccattttgagcagcataagcgtgggctccgctctcaatggctcgccaatcgttaccagacgccattacaaccgcatcaattccattcataatccctttattgtgcgttgctgcccgatatgggtcaatttgtgcataatcactagctaaactaatctttttagccacttctactcccagttggttgactggaatttgacacgtaacttctgtcagagcttggtcagctaaattagataatattgccatatcaacagcgatttgttgtgttactaaatctttcttaacagcctctaccatggaattaatcgtattcgctcccatggcttcgcgcgtatcaaccaataaatcaactgacagtttcgtggcggttaactgacgaacgcgtagattttttgcgccacctccacgagcttgcatcgaagggtgggctgcattagcgaccttcaataaatgtgatttttgtttttttacataattgattatgggggctggttgcgcactgctaattaataactggcccaacattatccgtctactgttcgccgaaaatcctccggctcgctggaccattttagctccataactagccgccgctattactgacggttcttcggttaccatgggaactacataagcttgaccgttaactactaaattaactgcgattccttctggtaaattaaaatcagtcagataattttcaatttgttgttgatgaattgagtccgtagctaattcagttagttcagacaaatcaacgtcagtttcctgcgctaattgctcgagttgctgttgacgcgttaatttgtggtagccttctatcattaaaactattcctcttttctaaaattgatgtactccgaaatgattccttcccgaacgccactttcagaaaaaattactcgatcagcgtcaatcatttgtaataacatcaccaatggtaacattccaccaacgataatatctgcacgcgtagtttcaagcccagacatttttttacgagcttctaaatttcgtgtaattaacgatttgaaggttcggttaaccgattcagttttgagccgatagccgtggatattattaattctagaaattttttggtgacgacgattcattcgggccaatgtccgattagctccgcctaagagaacaatgggtttattgaaagcatccataatccaccaaacatctcgtagttgcttattcacaaaaatttcagcggcaaataaattatctgctctaactacgtccgttaagcggaaccgttccgataaagacacagcgccaatcggaatactgatcatatttcgcgcttttccattatggacgtcaattagctcacagctggcaccaccagtatcaagtatcaaacaatccttaacttccaaggaattgattacacctaaataatcgtaataggcctcatcgtcgccagacaagacgtgtaatttaattccagtttcttgcttaacgcgatttaaaaaatcgttctgatttcgcgccattctaacagctgctgtcgtaatccctctaacttctgtattaggatattcttcataaatttctttaaatcgacgtagggctgcaatggtacgattcattgcttggggacgtaaaaggcgctcgcgccccattccttctgaaattcgtgaatcttctttaactcgcttaatttctcgaaaggttccatcatcagcaatcgaattaattgccattcgagcggagtttgatcctaaatctactattaccaaatttttcatcctggtgtcctcatttaaattgaaatattccttttttattttaccattacctaaattagaaaaggagctcatctcgcctatcaactaaaataaaaacaaacgtttacattaatccttaataaaaaaccacacttcttttagaagcatggcttttacgattaaagtcggttatcaaaatagttaattccaatggcatctcgaacttcctttaaagtctgttctgcgaccgcgttagccttgtcactaccgtcttttagaatttggtatacagcgtcaatatctgcttcatacttttcccgacgctcgcgaattgggcgtaattcgttttggagaacttcatttaagtaacgtttaattttaacgtctcctaatccaccagcttgatactgatctttaagttcttggactttttgcttatcaggatcaaagatgtctaagtaagtaaatacggtattaccttcaatatggccaggatcttctacccgaatatgttgaggatcagtatacattgacataactttcttttggatagtttcttcgtcatctgccaaataaatagcattacccaatgatttagacatctttgcatttccgtctaatccaggaattcgtcccattcctttaggtgggaaatatccttctggttcaactagcacttctttttggtagatattgttgaaagaacgtacaatttcacgcgtctgttctagcatgggttcttggtcatcccctactggtacagtatctgctttaaaggctgtaatatcggcagcttgactaaccggataagtaaagaaaccagctggaatactttgcccaaatgccttttgtttaatttcagttttaacggttggattccgttccaaacgagctacactaaccaagttcatataatgttgagtcaattcacttagtgctggaatctgtgactgcacaaagattgtcgatttagctggatcaatgccaactgctaaatagtctaaagcaacttggattagactattacgaattttttcaggatcacgggcattatcagttaaagcctgcatatcagcaatcatgatgaaagtttcataatcacctgtattttgaagttgaacgcggtttttaagtgaaccaacatagtgtccgatatgaagttttcctgtgggacggtcaccagttaaaataatttttttagatgtcataatttcctccagatataaaaaatcctactattcaaaaatgaataataggacgaaaaatcgcggtaccacctaacttgtgactccattataaagccaccgctctagtgaaagataagggatttcgccctgttaaacatcaatccatttcgccttccatgagacttctcaacaactgtctctctctgttagtggttaactactactttcattttaaattagaaacgttagccttgtcaaaataagtttaactttatctcacaagctggtctttcggttgactttcattcttcctccacctagaattattcaagcattaaaatcaaggaggtggctgatttggacgaacaacaacaagaacagcaacgagttacggaagtcattgaaaaaatcgacgaacaaaaacaacatacagaagatttatatcataaagcccatcaagaaactagccaggttgaaagaaattactcacaaaatgcaaaggttaacttgattgaggccgatgaccgcatcgaaacccatgctgaaatccaacagcaaaaagggctggtagctcgagctgtcgagaatgaagcaattttaaaacgccaaattgatgaattaagcgatcttcaaaaatcaccctactttggacgaattgatattaaagatgctgatggacctgatattgaatcgctttacattggaatttcgtcttttgctgatcgggatggtaatttcctaatttacgattggcgtgctcctatttcaagcatttactacaatggtactctgggaaaagttaaatatgataccccagcgggcatgatggaaactgaactcattaaaaaacgtcaattcactatcaatcatggtgaaattcaacatatgttcgacactaacgaaacggttggcgacgagcttcttcaacaagctttaggcgaacaaaatgacgaatacatgcgtaatatcgtcgctactatccaaaaggaacaaaacgacataatccgcgatgtttatagtgatcttctagtcgttcagggcgtggctggtagtggtaaaacctctgctatcctacaacgtatcgcctttcttttatatcatagccgaacttcattaaatgctgatgaaattgtacttttttctcctaataagttgtatagccgttatatttcggacgttttacctagtttaggggaacgaaacatgcgtcaactaaccttagccgaatttttcagccgccgtttggaaggcatgcaggtccaaacgttatttgaccgttttgaaaatcaacaccaactcactgaatacgagcaaaacctcatagactttaaagaaagtcaggattttattgaattaattcaagcttatgaaaaacaactttctgctaaagaaattaaatttatcaatattaattaccgcggcgaaattttcttttctaaagaacaaattcaagctatctttgaaacctttcctcttagtatgagcaataaagaacgtcttttaaaaactaaaaatgcgctaatcaaacttcttcaaaaacgagttaatcaagaaattaaacaggattgggttcaaaatcaaatcgaccaaattagcgacgaaaaatatcatgaattagtggggacgcgtcactttaaatcatatgatgaggaaaatcattttatcggtcgccaaatagttgataaagaattccaaattatcgatgacgctatctttaataattatttcatcgattcctattctcaatacgcggactttttgagtcaaatcgacttaggtgacttcgattggcaaaaagttgctaaagctttcactgatgcaattgaacttcatcagattcatctggaagatgcggcacccatgatgcttctccgtgatttgattactgggagtggtactaatcgtaaattccaatatgtattcgttgatgaaatgcaggactactcagttgcacaattaatgtacctaaagcatgcttttcctcgcgctaaattcaccttactaggtgatagtgagcagaccctgttcaaagatgttaccgaaccacaaattctattagcaaagctaaagcaggcttttcatgttaagcgagctaatttaattaccttaaatcgtagttatcgctcgaccgcccaaatcactaattttgccgcggcacttctacccgatggtcataaaattcaagcttttagtcgtgaaggagatttacctaaagtaatcattgctgataatgaacaacaagccgtagtcgatatgaccaatctttgccgggatgaattacagcagtatggtaccatcgctattttaactaagaacatggctgagagtgagcacgtagcaaccttgcttcacgaattaaaaccgagcttattaaacgatggcgaccgttccttacccaaaggcattgtcgttttacccatttatttagctaaaggattagagtttgattccgtaattgcctataatgtttccgaagctaattttcctggtcgtttgtggcgaggaactttatatacgatagcttccagagccatgcatcaactacacttgattagtattggtaaagtatccaatttaattacccaaattaagcccgatcaatttagttttcaaaaatcatttaacatcactcctcataaatcacaaaaactcgacgaataaccgtcgagttttttgtttacattacttcaattaatcctactccagcaatcataatgattaagcccgcaatcttagcaactgagatgctcgatttcatcgatcctaataagccaaactgatcaatatttaaactactgataatttgtcccagtaaaactagcactactaccgttccagttccaatctgaggtaccaagtatgcatttaaggtagattgcaaatttaatccgaatttttggacaaatttgtcagcataacctgatacggtgtttgccagtcgagtattttaagcggtcgctggttaatttggagtaacgtcgtcgttaaatcttgagcactaatgtgctcaaaacgagtccctttaggataaaaataacgtaaattccgattaaagcgttcattactaccacgttcagctggcgtataagcatggcagtaataggtcttaataccatattgtgattcaagtgatactagcccactaaactcagtgccacggtccacagtaaagctgtgcaccggaccattaaaagtggttaggaacttagttagtgcttcattaacagtcgctgtcgtccgatcttttaaccggtatgcccaaaggaaccgtgattttcgatcgattaaagttaataaaactgccttactatgcccacgaggaccaacgactgtatctagttcaaaatcgccgatgcgattacgttgattaatcatcatgggacgctgttcaattgatcgccccaaagattgattatatttggatcgttggtcaacgttacgccgttggcgtacgccatgttcaggtagatcattcaaagagaaaccaattctcccctgatttagccaattatagccctagttcacaaaaggtttcgattttaattcgttcggaataggttatactagacaaaagatcagctcctaaaagatgggtttgtggtaaacaccattttaaaggaagctgatcttttttgtccgaacagcgttcggattaattttacaatctaccttaaaaagatataagctgctccaaaaaaaccgccaatccaaacccaccaaggtgttttctgttgaacaactagccggatattttttaaagttccttggaatacagctaccaggaataacattattgttccaataaaaaatgatattaaagcagcgtgaataggggcctgtaataatccgcctaatcgtccatttaatgctgcttgaattgcgagcattccgcccacaagcacgccgaaaatttgccttaaccatttccacttaacccgttgttcagggggtcttttcatagaattccgtgctaaatattctggtaaggcgaccacaattaatacccccacaatcaatagtagaactccgaccattcgcattaacgaaagtggatggcgtgtggtgccaaacatgccatagttatcaattatcatactcatcataatttgacctaaaacgggcatgatcaccgtttgaacactacctaaaatggggaataaaagaatattagttgttaatccaatcatccccaaaacaccaccgaaatacatccaccatggaatggcatgtaattgcacattagttaataagagctgtccaccgcttaaaatgatgattactaacaaaaagatggttcccaccataaaagaaatcaaagacgatacgaatggtgaaataacatacgttcttaatcgtgaattaaccgccgtttgaaagggtactaccgcacccgcaaccaatcctaacatcaatagtcccattatgtgcttcctttcaacgctatcctagtttcggttaaagcgtttccatcattactataactttattttaaactaaaaaaatcatgacacaagcaacaatgtcatgactttttacattttccttttctattccacattgataacaatttttcctctagcatggttagtttgactgcgttcatgagccgctcgtaatccatcttcagtaagtggaaatgtactatcaataattactttaacctcgcccttagccactaaatcacctagttcagccagttgtttgccatttggttggagccaccaagaagttgctgaaggttgagcgtcctgttgggcttgggttgggcgacccgcgatggtgaccaatttcccagttggtttcaaaattgctagtcccgcttctaaatcatcaactgtatcaaaaacagcatcatactgtttaaggacttccccaattcggtgttcatggtagtcaatgacttcatctgcccctaaattagttaaaaattctgtatttttggcgctagccgttgtggctacataggctcctaaatgtttagcaatttgaatggcaaaaatcccgactccaccagctcctgcttgaattaaaactttatcaccctttttaacctttaaccgatctacaatcacctgccatgcagtcagtccagctaatggaattgcagctgctgcttcaaacgaaacattgctaggctttaatgctaatttatcttccttaactgccgcgtattctgcatatgtccctttcgtcccatcttcataaatatcgggtctagcaaagacttcatctccaactttaaaatgcttaacatctttaccgacttgggtaattattccggaaagatcccatcctaaaacaactgggaattgccaatcgtacatttgcttcaaaaatcccattcgagccttccagtcaatcggattgatactggttgctttaatttttaccaagacctcatcatttgcaatttgaggaatatctaactcctcttcatgaagttggtcaacatcaccatatgcgctaatcgtaattgctttcattaaaaatacctcgtagttttcctcttactttaagattaatctagtaggttatatgttaacacttatcaaaagtaagttctatattcggtttctagcaaactcccagaacaaatttacaactggtaccatgtctccctttcgttttataaaagctaattggctgctttttttaggtatgattggaattactgcaatattaggatagtttgttagatcaaatgatttatccataacaacagaaacacccattccttcattcaacatttccaaaatcaaatcaatcctttggccctcatacattattcgtggttgtacattaggcttttttaaaattggaataattggatttgtaccagaaattgttccttctaataccaaaaaagattcgtttctaagatcctgaacttggatcttttcaaaccgagacaaggggttatttttaggtactaatacaacaaaataatcggattcattcacaattacgtcgtatttttcactgaccggactaaatatccttgtaaaaacaatatctgttccctcatgattaagttcatttaacaaggaatccgttccggcttcactaaatttcaaattaatctctggatattgcttggtgaattgcgtaatcgtatcaaatgctgagtattgcgaaattgaggggattcccttaaccactagcgtacctttaggattatttttcaaagcatcaattttttgcttcaattgttgttctttatctaaaatctcccttacatctggcaatacatttaaagcctcttgggtcaacgttacttttcgatgttttcttgaaaaaagttttatgccccattctttttctaacgccataatatgcttagaaactgtagcttgcgttaaaaaaatttcttctgctgttttactataattcttagtctgtgctaaattataaaatgtcgctaattttttagtatccattacatatcttccatctattcttatttggaatatcttaccacaatatttgaattgttccttacttttatgaactgtagaataataccttgtcagctccaaaataagtacttaatcgatataaagggggattttggtgccaattggtataatagtaaatgttttttcaatttttttaggcggttttttaggtgctctaggtggtcgaaaaatatctaccgtcttccggaacaatgtaaatatggcctttagtatcgcttcaataaccatggggatttatacaattgcccctatgcaaaatctagctgcagtcatatttgcaatcattatcggaactggtataggaactttacttcactttggagattatattaaacatggagcagaatggatgcaaaaatttatttcacgttttgtttcttcaccaatgatgttagaccaagaaacttttgacgcaactttgataacgattattgtcctcttttgtaccagtgggactgggatttatggttcattaactgagggtatgaatggggacgctaccatcttaatttcaaaatcaattcttgatttttttactgcaataatttttgcagcaaatctgggatatgtggtggcgttaattgccgtccctcaatttttgattttaatgctactatttttcttggcccacctaatttatccactgactacccctgctatgttacttgatttcaaagctgctgggggaatccttatgctagctagtggttttaggattgttcaaatcaaaatgtttccaacggccgatatgattccaattatgattgtagttatgcccatatcttggttttggacgactatcatcctaccgctactatgaaaaaacgatgttaatttatgcacgtaaaaatcataaattaacatcgtttttatatattatttcataaacgctttaattcgccttactgcttcactcaataatgtttggctcgtcgcatacgaaagccgaatatgtcccggcattccaaacgcttcaccggcgacaacggctatatgagcttcctttaataaagccatcgccaagtctgtagatgtggcatatcctttaattttcatagcttcagtaacattcggaaataaatagaaagccccttctggcttatgatcaaaactaaaaccggagattgtttgcattaaatcaaaagtttggttcaatcttttttcaaatgccaatcgcatctcttccactggcttttggtctccacgcaaagcttccagagcggcatactgcgctaccgctgtcggatttgatgtcatatggccttgtaaagccaatatttttcgaataatttgcggagcagctacaacatatccaattcgccatccagtcattgcatacgcttttgaaaccccatcgattaaaatggtattattaacaatttcattccccatactcataactgaactgaattttgccccattgtaaactaatttaccgtaaatctcatctgcaactaatattacgttgttatcgaccgcccattgtgcaatcgcccgtgtttcttcttctgaatataccaatcccgagggattttgaggcgtatttaaaattaacaattttgtgctggctgttttaaaacgacttaattctgaaggagtagttttcaagtcactagcttgaggatggatggcaatcaccgaacccccggccaatttcacctgttcctcataactaacccagaatggggcaacgatcatgacttcatcgccttcattcaataaagcttggaaagtttcgaacagccccattttagcccctaccgttactgccacttgttccattttggcatcgcaacctgtatcggctttaatgtgcgtagcaactgcttggcgaagttctgggagccctccgactggtgtgtaataacttgctttaccagattgcatacttgccatcgccgctttaataatcgccttaggagtagcaaaatccggttctcccgtactcaaattaacaacgtcgatgccggccgcctgcattttttttgcctcaattgaaactgctaatgttgctgatggactaacttgattagcccgcttcgaaaattccatcagattactccttttctagttcaatcaataaatcccccgtctcgatttgcatttcaggggtagcataaatcttcttaatggttgcgtcgaaaggtgctcttaacgcggtctccattttcatcgcctcagtgacaattaagttatcacctcgctggaccttttggcccgcttctacttggacttcaatgaccgagcccgccatagtagcgccaatctgttcggctttagtcggatcagctttaatcttctttactttcgttacctgcgcattaacatcataaacaatcacttcttcactttgtccatttatatcaaagaaaagtgacctttggcccgcctcatctgcttcactaatttctcgaaggacaataatgaccgattttccgcgtcccaattgtaaatcaatgcgttgaccaatatgcatgccttggaaaaagattggagtatctaataatggtactggaccatattcattttgacgttgaacgtattcggtcatcacatctggatacataataaacgacataacttcttcatcacttgcttggtgacctaaaaccttagttgcctgtttacgaacttgatcaaaatcaactggttcagctaaagctcctggtcgtactgtcaatggggcttgcccttttagaatcaccttttgaagctgttttggaaaaccacccgccggttgtcctaaatcaccacggaaaaagtttaccactgattcaggaaaacttaattgtcccttatcgttcattaccatttcaggcgtcaaatcattttggaccatgaatagtgccatatcaccaactactttagaagaaggcgtaacctttggaatatcgccaaacatttgattgacggttgcgtacatttccttaatctcatcccaacgcttgcccaaatgaactgcattagcttgctggcgcaggttggtatactgtccaccaggcatttcaattcgataaatttcagtttgtggtccatttaattgggtgccaaatccttcgtaatatggtcgaattccagcccaatattcatctagtttttccgctttttgaatgtctaaatctggttgacgctggttattagacaacgcatagtaaagagattgcattgaaggctgagaagtcgttcccgctagcgcagaagtggcaacgtcgaccacatcaactccagctcgtattgcttcagaatataagaaaataccgttgcctgtagtatcgtgcgtatgcaaatgaattggcacatccagatgattttttaactctgaaattaatgcataagcagcttgtggttttaaaattcctgacatatctttgattccaataatatgagcacctgccgcttggagttctcgagccaaatccacataatatttcaaattatatttagtacgattagtatctaaaatatcgccagtatatgccatggctgcttcagccacttttccattatcacgcacccgttggatagattcttcaagctgtggaacccaattaagggaatcaaagattcgaaaaacatcaattccatttttggcaaccaatcgaataaattcgtcaatggcgttgtctggataattttgataccctactgcatttgacccacgtaaaagcatttggagcatcgtatttggcattttagcccgcaattgttggagtctttcccatggatcctcacctaggaaccgataagcaacatcaaaggtcgcaccgccccaaacttcagctgaaaataggttaggcagacctttctggacttgatcggcaatttctaccatatctttggtccgcattcgcgtagcaaataatgattggtgggcatcccgcatggtcgtatcggttagcaagacctgcttttgttttaacagccaattgatcatggcatcaggtcccttactatccaagatctgtttcgcattttcatgcggtacttgtgcttcaaaatgtggacggactggccgagttaacactactggattctgcttttctaagcctgggtaaccattgatggtagtattagcaatgtaactcaaaagttgagtaactaccggggtttcagcttttaaatcaaagagttctggtgtctcatccacaaaggttgtcggagctaattccgatctaaaaataggatgatgaattaatttctttaaaaatgggatattagttttaaccccagcaattacaaattcattgagcacccgatccatctttaccaaggcttcgtcaaaggttggcgcatggacaattgccttggtcagaagtgaatcataatgcggagttacaatggctccagcaaaggcatttccagcatccaatctcacacctgttccaccaggtgaacgatacgtctggattctaccgacatctggaataaagttattcattggatcttcagtggtaattcgggcttgaattgccactcccacagcttcaatttgggcttgttgaggaacaccgatttcttcgtgcaatctttggccttctgcaaccttaatttgggtttgcacaatatcaattcccgtgacttcttcggtaactgtatgttcaacctgaattcgtgggttcacttccataaagtaaaattgattaccttctaccaaaaactcaatggttgcagcgttactataatcgaccgacttcaataattttaaagcagcttttcttatttgatcacggacggtggcagaaattcccaccgctggagcaaattcaatgattttttgatggcgtcgctgaatcgatgaatttcgttcatacaaatgaaccatctcaccgtgttcatccgcgactacttgaacctcaatatggatcggatcaactaagtaacgttctaggtaaatctcatcgtcaccaaaagacgaagaagcttctgactgagccatcttaaatgcttcgcgcatttcttgttgatgatgtacaatccgcatcccttttccaccgccccctgccgctgacttaacaaatataggatagccaaattgctctgcaaaatttagcgcgtcatcgacatctttaactggtttttccgttcccggaatagttggtacaccggccttaatggctgcatttttagcttgtaatttatcaccaaacatttctagtaattcgggtcgaggtccaatgaacttaatcccagctgcttcaactgctcgcgcaaatacagcattttccgacaaaaatccatagccggggtgaattgcatcaatattattttcttttgcaatacgaataatgtcatcaatatttaaatatgctccaattggatcactatcttcaccaacttggtaagcttcatctgctttaaaacgatgcatagaaaattcatccgctttagcataaattgctacagctgtttttccgagttcatgcgttgcccgaataattcgggtcgcaatttcacctcggttggcaattaaaatacggtgcatagtggacctccctaattaaattgttcgtgatttaatgaatatttaatgttcattgtatcaaattaaacgggtcttgttatgtaatttgataaataaaaaaactaaacttagaatttgatgaaaattctaagtttagtttttaagcataagtagctgctttgtttttcttaatagcatccttcaaaataaacggtgcaatgagggtaaccaaaacaatcactaatacaattgctgaataataagtttcactcattaaatgttcaccataaccaatttgtaaagtaattagcgccatctcgccacgggaaatcattccagctccaattaccccactactagttaaatcaaatcccgacattcgagctcctaatccacaaccaaataatttggtaatagtggctaaaatagttaataccacaattagtcccagtacagtttgaagtccatcaaaattcattgataaaccaacactaacgaagaaaactggaataaagatagcataaccaattggttcaatgctctcattgatttcatcatcttcatcggttaacgaaacggctactcccgcaaaaaatgcgccgatcgctccgctcaaaccggctacatcagccagccatgctaaacctaaacaaataataatcgacatcactgggcgcgaagccgtaataaacagttggtctgaaaggcgcataagcatcggaaccacccattttccgatcacgtatactccaatgaagaataacacttgataaaagatggccatccccacgtttgaattggatcccgatttagaactagtcaacgcaatcatgacacctagtaataaaactccaataatatcatcggctacagccgcccccaaaatggtggccccctctttagtatttagggtgtgatattcctttaagacttccacagaaatactaactgaagtagctgaaaagataaccccgatgaatagtgcttccatcggatggactccaaaaagaaggctcgcgccaccgactaatacaatgggtaaaactacccctaatatcgcaactaccagcgccggcttgatgtattttttcaacattttcagatcactttctagtcctgctagaaacatcaggataattaccccgatttctgaaaacactgatatcaattcgtctgaatgaataatccctaaaattccaggccctaaaataattccgaccaataattgtcctacaactgcaggaaatcccatttgttgagcaaaatgaccagctaaaagggtcagtactaaaattagtacaagtacgcccacgaactccattaaaccacgttcctttcaaaataaagctaaattataacaatcactaattaagtatactacatatagcctaaatcactggcttccgtaggataagctaagatttgattgttgatttgatctactaatcccccttgattaataatcatcgttaaatcattaattagatgttctgcttcactactcattgtaattgcaccaacaatttttccactggacttttcatgaataacactaattttggcgaacggatcttgtaaacgccgataagtaaaccattccgtcatctccgctgtctttatttcatattgttctggatgttgctgcgcctcatctaattcaactcctgccttagccaatttaggcattccgtatactacggtagggattgctggataatcaatcgctgcttgggttgcattcgttagctttttagccaaataacgggcttcaaatccagatactggagtcagtttaggaagcgccttggaaacaacgtcccccatcgcatagatattatcaaccgatgtttccaaatactcattaactacgattccaccacgatcagtttgtacaccaatcttttctagatttaaactatcatcattgggttttctcccagctgtaacaaaaacctgatcaacgatttgcttgaaaccttgtccatcactcaactcaaaccgttcatccttaggttctacccgctttaaatcaattcctaagtgaacttcaactccttgagttttaagttgatcgattaagtcatcgacatatgctttaggaaaagcttttaatgggcgttgattatgatgaataatgtgtaccttagcccctgcgccactagcaatcatcgccaattcaaatgctatatatcctccaccgaccaaggccagttcatttggtagatgatccatctttaagaaatctgtactagtctgcatcatctcttgattttcaatatttgttaatctaccagggcgttgtcccgttgcaatcacaaatttttcactggcgatggttgtttgatcgattttcaaggtgtggtggtcaataaattcagcatgcccatcataaacatcgatttgagcgtccgttaaacctgaacggctgcttttagaaactggatctgtaaatgttttttcaaattgcattaaagccggccaatcaatttgagtctcatttttaattccattaccaagtaaatattgattttgttttttagcttcaatcgctgctaatagaacctttttagggtcgcatcctcgattgggacacgttccaccccaaagattttcttcaacaactgccacttccaaccctgcttcttttaaaggataagctaatcctaatccaccaggccctgctccaataatcacaacgtcatactttttcatttaatttacctccctcaatgtttggtttcacttaaatacctaaataatgatgcccggtcaacccaattaaccgttgatttatcttcatctactacttttaatatttctacttcagtcattgctgcaaaagctttttctaaagtatctttagcattaatttcaaatattggttctgtctcatgcggttctgaaatttcaaagcccgttcgaataattttttcaataggtgtcttatatagatttttacccaccgtagccgagaagaaattctccacaaacgcattttccggattctgtgcaatttcctttggggtggcgacttgcaataatttaccatcgttcataaccccaatccgatctcccagctttaaagcctcatccatatcatgggtaacaaatacaatcgtattcttcaacttttggtgtaacttcaaaaccaaatcttgtaattggtttcgcactaatggatctaacgcactaaaaggttcatcaaacaggacgaccggtggttctgaagcaatcgcccgtaaaatcccaatacgttgctgttcaccacccgaaagatcacttggacggcgatttcgatacttttcaggatcaagatcaacatcactaaggagttgatttacccgtctttttatatcttcttttttaaaatgtttcatttcagggattaatgcaatattttgttcaacggtcatcgtgggaaataatgcaatttgttgtagaacatatcctacattcagtcgcagctctcggagattgtaatccttaatcttcttaccattgaacaagatatcgccttttgtttgaacgaaaagttgattaatcatcttgagtgtcgtagtttttccgctaccagaagttcccactaagacaaaaatttcaccttcttgaactttaaaactaatatctttaattacgctatgatttccaaaatcctttttcacatgttgaaattcgatcattgttttagccactattttccgtctcctttcaacaaaccttttttaactaagtattgatgagccactacatcagctgatttcttttgtacattaacttcataattcatttcttgcatttccgattctgaaattttaccggctaaccgattaagtgctttgacaacttgcggatgtttattggcaaagctcgttttcattaagggcgccccttgatatggagggaaaacatgttgatcatcttttaaagtcgttaaattcaattgctttatttgactatcggtagaataagcatcagcaacattaatctgtccgtttttaatggcggaatagcgtaaggaagcctgcattgaacgaactggaaaatctaattcgtaagcctttttaattcctacccaaccatctttacgatgaataaactctaaggtcatgccaccttttaactgattttcaatattttttaaatctgagattgtttttaaatcatttttcttggcaaaatcctttttaaccacaagggcattcgtattttgatatttcatcggttgcaggtaatccatttggaactgttgtttcaataatcgttgggcatctaagtaagtttgatgcgcactcgttttttgagtaggggctttcttcaccaatgtttctaaaaccgttcctgtaaattcaggataaatatcaattttatttgattttaaagcgttgaataaaaaggtggtttcaccaaaattttgtttcaataccactttagttcgtggactttcttgctcaattaaatccttatacatattaataagaatatccggttctgctcctaattttccggcaatcgtaatggtttcagttttaggcattaccaatcgcgtgatagaaatcccagctgccccgatcactaatactgctaaggtgataatcatcttcttaattgataaacgctgaacgacgctgatgagtgcacttaatataatcgctaaaagggctgaactaattgccccaactaaaatcagttgtgggtcattccggttgatcccgagcagaatgaaatttcccaagccccctgctccaattaaagctgctagcgttgccgttccaataatcaataccagtccggtccgaattccagaaataatgactggcatcgctgttggtaattcaactcggaaaagtttttgtgaacgacgcattccaaaagcgtccgcagcttcctctaaggaaggatcaatttctgtaattcccacatatgtgctttgaaaaattggtaacaaagcgtaaattaccaatgcaattacggcgggtacactgccaatccccactaaaggaatcaataaccccagcagtgctaaagaagggattgtttgtaaaactcccgtgacttgtaataataattctgcaactttacgatgatgggtagcccaaattgctaatggcatcgcaattaaaatcgcaattaataatgatagaactgaaattccaatatgctgaagtagtgcctgtcctaactcacctttttgttcagcaaaagtttgtattaatgctctcatcttctcaacttctttacgcttatttaatatttaaattatctcataaaaaaaatggtatccctaacaaaaagcctggttagagggcaccacttagttaaaagttggtttttatttcagctggttcagttttaacgatgacctttccattgtggatcgaatacaataattctttccgttcgttaagttcattataaaaattatcagtgttaaaaattaaacaattagctggttttccaacttcaattccataatgatctgtaacatttaaagttttggcaccgttattagtagttaaattataagaattcataatttgcgaatatcccatcaattgagttgcatgaattcccatatggatcgaatctaacatgtttccgtctcccattggataccaagggtcttttatatcatcttcgccgaaggaaacattaacgttattttccaaaagttccttaacgcgggttaacccgcgtcgttttggatacgtatcaaaccggccacccaggtgcatgttaattaatgggttgcataccatattaatattggacatctctaaaagacgcattagcttataaacatacgcatcgttatatgagcccattgccgtagtatggctagcagtgactttattttttaaaccactttcataagctaaagtagctaagacttctaggtgacgtgaattaggatcatcaatttcatcacaatgtacatcgataagtttgtcatatttttcagcaagctcaacaatatactttaaggaatccacgccgtagtcacgattaaattcaaaatgcggaattgctccaataacatcgacgcccatttcaaccgcttgtttaatcaggtttttaccattttcaaacgataaaataccttcctgcggaaaggctaccaattgcaattccataaaatcttttacttcatcttttacttctaataaagcctctagagctgtaaaactaggatcggtagtatcaacatggctgcggacgaattgaattccatggctagcttgctttttcaacgtttgaatagcgcgttctttagtctcttttttagttaaggtttgtttgcgttctgaccaaatacgaattccatcaaataaagttccagtttcattccattcgggatctcccgctgttaaggtcgcatctaaatgcacatgtgaatcaataaagggtggtaaaagtaattttccattggcatcaatcaccttgtcaccagatgcttcaagatttttaccaattgctttaaaaattccattttcgattctaacatcttttacttcaggatcattttcgatatgaacgtttttaattaacattgctattcctcttttcaaactgcataattagccaatataaaattccaataataatcattacaatgaacgttgccccagtataggtttgaacaaagtccaatttctgtaataagctgtaaaaaattacgcctactaaccataaaataaaagccgtccagtggataccatttttataccagtatcttccgtttggatttcccaattccataggatcatatttctgttttgaaataaggaaataatcaaccaccataatactaataatcggtcctagaaccatacctacatagtccaagaaagcggtgaaggtttctaaaaagctaccatagaaaaccggtataaaagttactaaggttgcaataaccgtggtaatgagtagtgactgttttaaagttagcttagtgaacatattgtttaatgctgaacccgctgcctgaatattgacggcattggccgtcatgctagtcagcataattacaatcattgcaatgagccctaaccctaatctattagcaattgtacttggatcagaattattaggatcgtacacgcctgaactaattgcaatacttattgtggcacttaatccaataaatgcaaatccgaaaacacctaagtttgctcctagaaaaggtgcggtggtcgctgtaacagatttcttagtaaatctagtaaaatccgcgccagcagtcacccacgctaaattaaaggcggctaacgtgtccatggccgtcccaaaccccattttaagatggcttggaactttccaagcagcgatttggttaaaggatacatctttaaaaactactattgattcccaaatcacaaagataataactaagataatcccaattcgttcaataatttgaatggatttctgtcctgaaacaatactaattaaatgtaggatactcatcactgcgattcccataatcaatcccagatttccacccggttgaccatatacaggccatcccaagaagctgtgcaaaatatatgatacagaagtcgcagcaataaaagtattaactgctgtccaaccaacaaattgtgtcaaattaacaatcgaaggaataatgctgcctctaattccaaaagaagcacgtgacaacgccattgttgtaactccagttttggtgcccatataaccaactaacattaagaatatgtatgaaatactcgaagctaaaattaaggctttaattccgccccagaatccacaagcagcaataattccaccgatgaaccaggttccattgttagcattagcaccaacccaggttgcaaacatatcccaatatgtcatatgtcgatgtttcttatcaatactttctacttggtactttgtattcattcgcacagttcctcctagtattttttacacattttaaaaaattatactagattcactgtatacaatcaaagatgaattggttcaaatttaactttcaaaacaaaaaagaggatacccatgataataatcgtggtcatcctctacgtattaaaaatttatttttaagccactagtcggacttgaaccgacgaccccttccttaccatggaagtgctctacctagctgagctatagtggcatttatcaactaagatagtatatcatatttatttacgctgtaaaaccaaaatatgccatgtagcttaattccgtatcgggttatgctgacaaatttgtccaaaaattcggattaaatttgcaatctaccgaaaattatgtaagtatgatcaaaataaaatgctttgtaaattgcctagtaaagaatactttaaacgtttcgatgctcagattaacatatttaaatgtgaaaaatgtgaccacttcgaatcgaatgagtgtatgtgtgaaaattgtcgaaaaaattatagattagaaatcaaaaaaatatgttcgaataaagaaaaaattgatttaaatactttagtactagaagataggattttattagcgacatttctacaatattgtcatgtggactcgctacataaagatataggtacatttaatgaattctatgatgatgagtttccagctttttttgatgaaacgaagtatctagaaaagcttgcaagtaagaatattattaccatttcacctaatagtgatattgatgcatttgtaatggaagaaggattgatatctgcttactatatagggaaagttaagtggaatgttaatgtgagtacagaaacaattgatacaaaatacttactggaattcttaaaataccctaattattctttagtaacagatagccacgatgttaactttatgtggcgtgaaatagtaatttacgaattaatcagattgtgtaaaagagagatggaagaatttaagtttaataagattaatgacgaagaggatgaattatatgacttatttgttcggctctctgaatggctatcaccagctcaaatttattcattgatctggtttagtgttagaagggcagataatcagaggactaataatacatggggaaactataaatttcatcaagttgagtttattattaaaaatattgaagaaacagctattcaaagacaccaaaaaggtaaaattttaaataattatgagtatccttataaaactaataaaacactactaactaagatattttttgaacaattattacaaaaaccggattggtttgatacaagaataccaagtctagaagaaagaaaaatcaacaagaagataattttttacgaaaatttaaagcataaagaaaaagttaactttaatgaagatgatgttaatgttgggtactattatttaactaaatttggaatagtaatttatgatggtaatgtaaaaaaactttttagtaacgaggagacgctatataaaatatctaagtttattgataaaacagatgacattgtagataaggatgatgaattttattctaatttggatatactattctatatagaaggggtatattcattatcatacttaatgggaatgattattttcttggaacaaaataactgttgctattacctgcctgaagaagacgaaaaagaaattttatggattgaggaaaagttatcaatgtaaggtataaaattgataatttagaaaaaaactctttaaagagaaaaaatacacaagaaatacttaaaaactactcttaaacatagtaccacggcaattaatttgaattacgtactgtcatttataacagcaagatagttttatatcagaataaagaaaaacaaaaaagctgatacaccaaggattacaaacccttagctgtatcagcttttcctattcaatggagtcggcgggttttgtacccgactgctcacaaacgttgatataccaatgttttacatagctaattcaaaaattggctaagcttttggctatgttttataaaaaatatgcttgtgaggccacaatttaattgggtctagaatttttggtgttggaaagtatttccattccaaaagtactaggccctttttgataacaaaaaggcatctaagcctccctagtgctatgctttaagcgacgaaactcaagataagcggggtagttataaatttctccgttaaaaattactgcttttgatttatcttcattgtaaataggttgcataccactgttgatatcaatgatactcaatcgacgaaatcctagcgccgtatcctcattaactaattcccccgaactatttggaccacgatgtttgatcgtatccatcatagcttctataactggctttttgtcagtaatcttcttgtctacgaaaccgacgataccgcacataataattctccttaaatttcaaaacttacgaatctggttgctgcaccatatccaaatatttggagcaacattttgtcgggattgatattaatgaaatatccagctaattcggaaatctgattatatcggcgatcccattttttattataatcagtcgttaggccatgttttttacccattaaggccgaacaatttaatattatatgattaatcccattaactttgtagtacttttcataatgcatgtgtccacaaatgtaattcgatatggtcgaaataccggtatcagtaaagttatagcgaacattaactccaaaagcatcggataatttatttttaagttgtccagaatccttattattaaagctagtaaaaatcttctgaactaagtcaccgttgaagttcaaagctgaacgaccactttgactgatcaaattagcatgaccaaaaactacgacatgcttatcaattgtcttttctaaaatagatattaaatcttcgatctgttgctcgcggataccacggacttttttgaagtcgtacttcttggtcccgccatttaggatataaggaatatcgctcgtattcaagaaaattactcgaatatcccctttatcgatccaagcaactttggaaccaagactcaagcgtttgatctcaggttgttcgaaatcatgtttcgttaccaaattatagtagtcgtcacgtctaaatgaggctgaagtaataaatttgtgttcatcatacttatcattttcatcgtgattaccttccagcacataaaaaggacgctggctattttggtaattttccatcgtgaattgtaacaatcctcgactgatctctggcttatcactaccgtcgatcaaatcgcctaaatgaatattgtaatccactggcaatgaatcgcaagccttattggcttcaataatatgccttacaccgttgagaccatagtacgatgaactggcaacagctttttcatgagtgtccgttaaaaccgataaagtcaagcaattttggctaacgttaggttcaacgttctttctaaaaacttgctcgatatattctgtaaaaaacagtctcggctttaattttctcaaaaagttatcagtttgaacagagataaattcagatagtctcggtctaaaaaattttttaataagaaatttgattttcacgatttttattctcctaattgactaaatcttatcatgttttagactccgacaaacaaaaaaccatcataaaagggctctttgtcaacgggtgttgatggaggatttatgtggaacttcgttcacttgcgaacggggttccttttctttactctggttttaaattcaatttgaatacgaaaaacaaagtttttccagttccggtatccgtatgctgtctgcttaatctgtttaatctttcgattgacgccttcaatgggaccgttggaaagtgtactactggtcatattttggatgagctttttatttttaataaacgttttgatggtagtaaagagttgaggactaacgttctcaacctcatcaagcgtcgcagtaaaagctgcatagtctcggttacgaaaagcttcgacgagtttatgagcggtgaagtaagtattttcaaactcatgactgagatttaaaccagaccagataagttgttcttgagtcagtctgtttcgtaaatgtgaaaaccattgtggttgacttttctcaagagcttcataattcataagatacaggcgccaatacggttttaacactcggtattcgggggtatctgggtgatactttttcattaactggacacgagtttggttcaaggctcataaggtcatttgaaccaagtgaaagttgtcgacaattaatttggcgttaggaaacagataacgaataacagtttggtattgtgcgttgagatccattacaacctgagtaacctgttcacttgctttcaattggttttcgtcgacttgattgtagcacagggcagtatgccctttttattttgttttacaaaaaaggcgtcgatggattttatccatcaacaccaaatatcatagagccattttaaaaagggagaatggaaaaaatgaaagactgatctaaaaaggttggtcttttttgtttgtaaaaagcaagagtgaaattgatggagttagaccagaaagagcattgatgttgtggatatatcatggatcaattagcgtatatacagtggacgtatgaggctgtatatgatgggtacaactactatcattgttaatgattgtaatggtgctaaatggctatatattactatgcttatgggtatgcctctctgtgcctgccttgttctggtctggtctatctatatgagcggtctatatgtcaggcagttagctatatactgttgtctggtctgttgtggtgctctggtatgcctttgtatagatatgtaatagacaagcatgtaagctctattgtgctggtatatagctctgttgtggtgtgctgttgtatttgatgtgtgcaagactgtgaggtggcggtctgtgtggttgcctacgtggtgctggtgtagcgtggttgtatagtgtgtggttagttgtgtctacggtgtccgtggtgttgttggttacgtgcgtgtgtctatctatgcttgtgcttgctatggtgttgtcggtctatgcttagccatggcgttggtatggttgtctagtgttcctatatggtgggttaggtgatgatgtgatacgtatgttaatggttgtctatgctgatgttatttgcctataagagtgtgacttggacagtgtgagacttttcaagcttcaaaaatcaaatgaaaaatgaaacgaaaaatataaaagtggtggctctgattgattataatcaggactttttttattatacatacattggataattatacattattatgaatattaatgtggtaaagtgggtccgaagagattgagggaaacaagaacataaaaaatacgatgatttgaaatttgtacggcttgaaatgctgatttaatagggcggggggtgatttagaaaaaataataaatattctgttaatgccacgcaaccttttgtatacgtacaaggtaccacatcaactttttaggtttatttatgtattaatgcatccccattttttgtgtaaaaaggggatgagtatttgttaattagttgtttcaatctcttcgataatatgtcgtacattgttcctatcgcaatcgtgttcttttttaaattccctttggctcaaattaaaagcatcgttcttcaatattttgaattttcccacgtcatcagagagggtgttttctatttgctgttgtagccggcccgtaccttttctattttggcctccaatttttcgaccattcgcttgggattgattaataatatctttggcccaccttagatgtgatggtaagttgccattgttctctaagtagtcacgtaatctaatggcaaagttttcttttgaccatttttccacgtgttccccgagtgtattaagattgtacaattccatcaagtaatcttgataggggttaagatcagtctccccgaaataattagtacatgcatttttaaccatattttctaaagctctgttgttagaatacaattctagttgcttacgagcatcccttcgaggagtattcagcatggtgtcatattcttcgatattccccaaatataaccaatcttttctacctcgcgttaatccagtatgaaggttgttaatagtatagaaatcatgactcatgggggaaataggttcggaacccatgtagaaacacactcggtctgcttccattccctgtacgttggccaccacacaaccacatgtgaactcgtattgttcagtgcctgccaattctgtgtctaatgttggtatgcttgggaagttattttgtaagtcttcaatgttagtatgatatggattgaggtgtacatcagactcatcgtcctttttagcaacaaaagggaaatcgttaactggcttgcaattcccagaatttgcaagtagtctattcgcttcgtgtatgcggtcatattttgggctgagaattagccacccctcattaaggcacttagacagatgtttgccgtaatttctggtaaaagagtgttcgtttctcaactcttgatagaattcttcatcatagtcatcggcttcccagtctgtgcgctccatgcgataattgcgatatagcgttctaacttcaatagtgtctacagtgttgttccaatcttcgaccacattaagagtatttttggttaacaggttagaatacagctgacccatccaatttctataggcactatcatccgcattgttgaacaggtgcctattagccatccatatggcatctaatgcaccgaacttattaataggggggagctggtggctatcaccgtaacaatagatattaacatctttcccatctttttctttgatattcctaacatggaataacaatgattcgaagtctattttcgacaactctccaaactcatcaataataatattagttgctttgtattcatcaaaagatgaaaagttaacgtgtgtttttctttgtaattttttggctagatcggtgttatccatattattgaggctatcccttagacgactacttgcagtatggtttggagatgttaagaatacatctgtgttatttatgtcatccaacgtattacttatgttagtagtttttccagtgccagcgttaccgacagttaatattaatttcacttttcccgttttcattaattactattctcctgaatttgatttaatcaccttaagaatttggtgatttgttaatatataacagattaagcattttcttagattaatatagtcacttttcatattttcgtagaaaattgaaaacctttttactttttgaaaaaaagtgaaaagacagcaactactagtactaacccataacaattaataatattgaattacagtactagttaggttatcaacttgcaaaaaccacaagttaataactgttcgagttatcgctacgcgaaactcgcccatacgatatctaatattaattaaaatctaaatggtaacttatttcgctcctgtgccaattccttatctcgtttagctttatctttttcagcaataaacttatcaatcatagtcataaccttagctttggatactggtttgatgcgattatccactttgggaaggaataccttagtaggattttttaattcaatcttgctaggcatagcattggagaaatgtggtttatttggaatgcgagcctcgaacttaatccaatcccatttttgcaatagtcctaatttttcacgtatttcttttgtataggtaatccatccaaaattaaaaaaattgtggttatcgcttccaatatttctcagatagacgatagggcgcctttctcctgtaattgattcaaatatgtcaaatcccactactgtagcgtcaaagtattctcttgtctgattcatcaataatgtcatcccttttctgtattttttaaaacataacccttacaaatgttgatataacagcacttataggcttgtatttggaataaaacattcattttattggctatttttagcccttttaagatagaagtctttattttcctctaatatatattggaggaattcccaattggtttctggtactgattgaggctttcttttggttagtaatctaactttagaaggatattctaatttatagtcatattgaataggatgttttttcttatggtggagtcattcccttgataacccttgagataactagacaccctagcattgaattgaacttcatcacctgtagccaaaatacccaaactttgaaattgtttagtgtaattaatccacagatgatcagctactagatttccattaatatccgttaaatttattatcaaaaaggtaggcttgccatgcccgttgtatccagtcttataacccagtctgctaacaactcccacatatgttccgcgttctttatttcctatttgcttaagtgcgtctctcataatatttactccttaaatttttttatacttagttaaataatttttattcttaaataagcctcgcaagcgtattttttattaattaaatgattttattcttcaggtattcatcgatggctaaacggtcaaagcgtagaacacctccaatctgcacggcgggcaatccttcggcaatagccttctggaaagttctgtaacatattcccatgtacttgcatgcctcctttttattcatgtatcgaggtgctgggctaaacataagagagagttgttccattaattccttattgtcagttatttgttttaattccatctgcaaacctccagttaatttttaagccactattacgtgactatgtatgatgcgctttatatagggtgcgaaaagagtttcaagtaaaaaatattaaaaaatacctttacactactaatatggataaaaaaacgagaatatgccaaaaagacataaaaaaacataaaaaaacatcaattagatacaattccatttaattccgtacacttataacatggggtaaaaatgtagtgttttactaaaaaaatctaataaaatttaccttacatagataacatagtgaaaaaattttgttttaagtaaaaaatattaaaaaatatccccatgtctatatatgtataaaaaaacgagaaaatgccaagaaaatacaaaaaatatcaatcagatacatttctgtgtcactgcagataatatgtataaaaaaaagaaatctcacaaaagaattgtaaaattttttaaatttattttttgagttgcctaaacaaagatttcaatgtaccatgtagctgttgcgggtctgactctgcaacacgggaggtcatcccaatattttcaaaaatgtaggcctcgcaagcaatacaggagcgaaaattaaaatggcaaaaataaaaaaatacacaacaaaaacaggaaaaattagatatgaatttcaggtgtacgtgggagttgactctctaaccggacgccaaaagaccacgagaagacgtggctttaagacgaggaaagaggcctccatcgtattgagtagattagaattggaaatcgaaaaaagaggactacaggaggatgagagacgctttttcagggatgtttgcgcggagtggatggaacagtaccgtttaacagtgcgagagtctaccttagagaagacccaacggattatcaatatccatgtactacctgccttcggaggtatgataattaataatataactccgaacgtctgccaaaaagttgttaataagtggtttttggaggctaagtcctacaaaaaatggctgaattacgcttcgatgatttttgattacgctcttagagctgaatatgtaagtcgaaatccttgcacgctggtaacaatgccacgagtacaggaacaggcaggagagaagctagaaaacttttggactagagacgaactgaatacctttttcgactatatgacccccaaaagggacgttgaacaattcaccatgttcagattattggcttattcaggtatcaggaaaggggaattactggcgctaacgtggaaggatatcggctttgaaggaaacacgttacgggttaacaagactcttacgcaagggttaggtggtaagttaatcgtgcaacccccaaagagtagggctggacgccgtacaatcgacttggatgacagtaccatgcgatacctcaggcaatggaagggtgttcaacgcgagacttttctggggatggggttcaatactaacaatactagtcagttggtattcgcaagcaatagaaatcattttcgctccatgaatacccccaccaaatggcttaataaagctattaaagccacgggactcaaacacatctcaattcacgggtttaggcacacacacgcctcactactgtatcagtctggagtaggtcttaaggagactcaacagagattgggacactcaagagcagacagtagcgttacgctcgacgtgtacactcatacgacagaacaacagaatgtagcagctttgcagaggtttgaaaattacgttgaggccaaataactaaaattggctaagctttatagaattttttgtaaaaaataagtgctttaaaccttgccataataggaataagtagcaaaaaaattggctaagcttttggctaagttttaggtcaattctgtgcaattttaagcaaaacatgaatatttagaagtacaaaaaaatcccgtcatatcaacgttttaacgctgtatacaacgggaaggaatagcaaaaatggagtcggcgggagtcgaacccgcgtccaagcatgtcgccaccatgacatctacattcatattcatactacttagatttcgcgaattaagacgccgtatgtcagggcttcattaaaacgctagtctgtaaatcctcttcttaagcacccaggccagtacttaagcgcaagtccacttcatttaggacccgtatctagcccatggacgagactaggcggatctacgttaagctactattaggcagctaaagcgtaagaattgttattattttttgcagttataataaactgaacgtttttacgtagccgtaacctacgaaatgcagtcatggctcgacccatacctgtcgaatccataacgaccccaaaataaaacctatgatctattatatcataggatgccaggttttaacggcgatttttatcgttttcaatcggaattggtcgataagctaactgttgttgaccttggagattgtttaaaagacggtcaagcaattctgaattttggaggttctttaaaaggtaatccagcaaagcatttttagtttttttcatgagaaattcctccttctatatgcactcatcataatacatgattcaagaaagtcaagcagttttgcctattgcttaactattccttaaatgtcacaatttaagtaactaggaaaagaggaggagagccatgagccagattgatgaaattcatcgagtcgagattgagatgttaaaagttattatcgaaatttgcgataaacatgatattaaatacatgctaatcggtggaacattgctgggggcgatccggcacgacggatttattccatgggatgatgatgtcgatctagggatgacgcgtgaaaattacgacgagttcgctagggtcgcgccagttaagttccaaaatacacattactttatgcaaacagcggatacggatcccaattttgcatttagttatatgaaggttttagatactaatacttatatagaagaaaaaaataatgttaatgatgcccacaagggaatttttattgatatttttccttttgataaggttcctcgtcaacctgaaattcgccaggcagtctacaatcgctttaagattaatgacgccgcaattctcgtgcgactagggtacaacattatcaaaacaccgttccgtaaagcgcctaacgagaagcctttagagttgttcatgagtgtagccaagttaaaagagcgacgtgaaaatatcatgcgcctgtatgataatgaaccatttcatcattataaaaattatgcttctcagtacgcctatgataaagaagttttaagtcagtccgaactaacggaactaaccacgcataagtttgaatccattgaagtttcgattccccaacactatgaccgtattttgaaacggatgtatggtgattacatgcagctgccaccagaaaaagaacgcgtttctaagcacattgatacggtgattattaatggaaaacgaatcgaatagaaccgaggaattttaatggaaaaactaaaagagcgcatggatgcgtttagtgacgcggtcattgcgattatcattacaattatggtattggaattgccaatccccaagcatgatttatttagcgaatatatgcaatttgataaagcagttggaatcttttttattagtttttgttttgtagcaaatatttggtaccaacattctatgttatttaatgatgcaaaaacaatgaatgatcatatttttattcgggaattcatttttttagctttcttaagtttgatgccaatttttacaaaaattattacttacgataccaatcggacaacggttttagcctatggaattttaaatattattgttaatggattgtttgtaaggcttagctatgcggtcatcaaacaaaaatataccgatcaacaagatattaaacgtatttttcataaggtctacggtaatcataataactttttgggttatgccagtattaccatcttggttttagcgtactttttccctaaagcgatggtggttgtttacttagcgatgcccgttatttcttttgtgacgacacgccatgattatacggatttacaagatgtcgcacagttacctaaaaatgaaaaggaacagttcttagagacgtcaggtagtagtcttcgtgaattgcgtctgatgcaacgtgaaattatgcgtaaatatcgtggaaaaggccgcaataatcctgaaatgcaggccgaactaacggcactattccagagtcacccagaattaaaaaataaaagaggccgtcgcttttaatgcgacgacctcttttatttaactatcttgacgagtggctgcgattgctaattcacggatgttaaccgcttgtggcatgtcataaatgaacttaacactttcagcaacatgtttaggatccatggtgatgccacccatactctttttccattcgccataatcgaccaaggcattttggtcagtaacgtgggtgaggagttcagtttcagcagcgcctggggcaaccattgagattcggacatttttaccagaaacttcttctcggatagtttcgctaagtccatgaacaccgaatttagaagcaacataagccgcatggttaacgaaggtcttcttaccagctagggatgacatattaatgatggttccatgttcacgctctaacatgctgggtaaaacaatttgggttccatttaaaacgcccataacattagtatccaacatggtttgccactcggttgggctttgggtagtcacgttgcctaatagcatcactccagcgttgttaacgagtaagtcaactggtccaaatttagcttcagcatgttcaatagctgttttaaattgagcttgatctgttacatcgacgctttcaatcatgacgttttcaaagttaagcggtaaagcttgaatcttttcaactcggcgacctagtaataattcagggtaacccgcctgattaaaaattttggctatttctgctccaaaaccagagctagcaccagtaataacaattaatggtttattcatattatgtacctacctttgttttatgatatatttgatgttactacttggagttaactccaagtcaaggaaaaattttaaaaatgaaaacatatttaattggcgatattgctaaaaaaatgaatgtaacaaccgatactttacgttattacgataaagaagggctattaccttttgctaaaagaaatgaagcgggtaggcgaattttcacggaagatgatttaggatacgtggaagtgattaactgcctgaaaaaatcggcggtgcctgttaaagaaattggtcaattcatcgagtggtgtatgcaaggagatcaaaccttagaacaacgctatgactttatggttaaacgagaagcggccttggaacgccaaattaaagaattagaaacgcagctcgcgttcttaagatggaagaagtggtattacgcccgggctaaagccgctaaaacggaatcagttaattttaaaccaggtactcagagatcagatccagccttatatgaccattatcaaaaactccatcctgcttcaaataaatttatcgagtaaaagtgcaatttgaaatttacaaaactgaatttatatgctaatctaacgagaagtagatataattatcaaccgtaagaagaacgagtatttaaagcccataacttaaagcgaattgaggatagtgcgagctcaaaaagttattcttttaagaaaaacatcttctttgtttctaagctgaaattacagtaggcttagacggggccggcccgttatagcttggaaagcatttcgatgcttattttaagatgtttaatttaattaaacgaattttgggtggtaccgcgaaagtccttcgtcccttctggggaggaggactttttttatttgtaccggactttttacgaggataagaatggaggatttattcatggaaaacacattagttaaaacactctactctcaagcagaacatgatgctgacgtagaagtggaagtaactggctggttaaaaaccatccgttcttcaaagaaaatcagctttttagaaattaacgatggttcttacatcaagaatgttcaggttatcatggacaacaatgcccttgaaaactctgaagaaattcgtaaggcagcaatctattctacaatcaaagttgtgggtaaagtggctgatacacctaaggctaagcaaccatttgaaattcaagctagttcaatcacaattttaggtagctcaaacagtgactacccattgcaaaagaaggaacatactcctgaattcttgcgggaacaagctcatttacgtcctcggacaaacactttctatgctgttttccggattcgttcattggtttcttttgctgttcatcaattcttacaaagcaacaactttgtttacgttaacacaccgatcatcaccagcagtgatactgaaggtgccggtgaaatgttcaaggtaacaacgctagatttgaacaacttacctaagaacgaagctggggaagtagattcaagcaaggacttcttcaaacaacctaccaacttaactgttagtggacaattgaatgcagaagcttttgctttggcttttagaaatgtttatacattcggcccagcctttagagctgaaaactcacatactacgcgtcatgcttcagaattctggatgattgaaccagaaatggcctttgctaaccttcaagatattatgaatacttctgaagatttgttgaagtacgtggttaactatcttttggaaaatgctaaggaagaattggaattcttgaacggtgccgttgatccagaattaaaagctcgtttggaagctactaaggatgctgactttgcccgagtctcatacacagaagccatcgacatcttaatgaatgctgatcaagaatttgaaaaccaagtcgaatggggcattgatttacaaactgaacacgaaagatacttaagtgaaaaggtatatcaaaaacccgtcttcatcacggattatcctaaggacattaaggccttctacatgcgtgaaaatgaagaccacaagactgtagctgcagttgatcttttggttcctggtatcggtgaattaatcggtggtagtcaacgtgaagaacgtctcgacaagatcaacgaaaagattgccgaattccatctcgatcctaaggaatacgaatggtacgctgaactaagaaaatacggtgaaactgaacattctggtttcggaattggattcgaaagattacttatgtacgtaactggaatcgaaaacatccgcgatgtaatcccattccctcgtacaccaggaaatgctagtttctaatttaatcgttaaaatgaaaagcacccaatcatagattggatgcttttttatttaaccatcttataatttaaaaaataagtgttgcgtagcaatgcacgattagtgcgaataatatgatagcccattttctcgaaaaaagggactgctgtaatagaggcataagtagaatattcagaggatgtaatggtttgctctaatttgtttactaggctagtagcgattcgttgacgttgatatttaggatgaacaaaaagatggtctaagtacccagatgtactcatatctgcaaatccaataacgccagaagaattaatggctactagagcgatattatttaaagtaggttttttccacttttgtttatcaatgttactccatacttcaatttgtttttgattataatctttttgattagtttcacgaatagacttagaaatcatcattaaagttgaatcttcgtcagtgatttgatatttcctaatatgcattttattatcctatcttttggtatgttaaataatatgattttttcgatatgtacgtggtgagcatcctaaatgggtggtgaaaaccttacttagataaaatggatctgtaaaaccggtttgttcggaaatttctgctaacgttagatttgtagtgattagtagtttttgaacttttttcaattttatttttgtgtaaaaacagacgggagtttcacctattatttttttgaaaatccttgaaaaataagcggtacttgtattggtaaattgggctatttcactaattgaaagagaagaattgtgttccataagttcaattgcagagttaataatgttatttctagataatgcttgttttggttctataggtttgaatttttttatttttaaaagcatgaagaaatcttctacgatatgattttggatataatgtgaatctgtgtttaaactgaaatttgttttacgtagaaattcacagttttcataaaagcgatgtgatcctaagtggtgtttacctataaaagtcggtgtgactggatcggggattactctaatgaaatggaaacacatcggttcaagcatattacgtttgaatttgacataaggcggaattaataaaatatcattggcagaagcgattccagaatattgagaaaattcaaattcacaggaaccgctttcgataatatacatcacataattggagtcgatatcagattctagttgaaaactaggtttgttttcccagtatgtatatccttgtgttagagtggccaaaagtatcacctctttttggtcaaaataatacatgttttgggcttaaaagtaaatggagtggagaattcctttgtagtactgttaagacaaaaggagggataacaaaatggtgacaatgttaaagaggaaggttaattctgatataactgttattgggggaggactggctggaatttgtggagctattgcagcagctcgtcttggacaaaaagttagtttagtccagaatcgtggagtactgggaggtaattctagtagtgaggtacgtgtttgggtagctggtgctactaaacatggtgtgaatcgttatgctcgagagacggggataatgggagagttatttgttgaaaaccagtatcgtaatcctgaaggaaatccttatttatgggatgtacttttgatggaaaaggttaaagcagaaccaaatattcaactatttttaaacactgaagtgacctcgatagtaatgaatcaagataaaacaattaaaagcgttactggttttatgtcagcatcagaaactttactagaatttgaaagcggttacttcattgactgtacgggcgatggtttaatcgggttcttagcgggagctgaatttaatataggacgtgagagcagtaatgtttacaacgagagtttagctccattcgaggcagatgaggatacgcttgggagttccttatttttctacacgcgcgacgtgggacacccagtgaaatatatcaagcccagttttgctaaagacatcacagaaacatcaattgtaaataaccgaattattcgaaaagaggataacggatgtgcctattggtggattgaatggggcggagaattagatattgtacatgataacgaaaaaatacgagacgagctacaatcagtagtttatggtatttgggattacattaaaaattctggaaaatatgatgcagacaatctaaccctggattggattggttcagttcctggtaaacgtgaatatcgtcgttttaagggcggatatgtattaaagcaacaggatattgaagaacaaacattatttgatgatcgaattggatttgggggatggtcaatcgatttacatccagcaagtgggatgtacaacgattctgttggtgcaaagcattctgttgcagatggtgtatatcatattccttatcgtattttatattcgcgggatattaataatttgttctttgctggacgggatgtttcagtatcacacgtggcttttggaacagtacgggtaatggctacttgcgcagtaatgggacaagctgcgggtacggcagctgctttggcaaatgaaaagcaaattaagccagccgcaatttattctaattatttgcaggaatatcagcaaaccttattgagagaggatggttctgttttaggagttaaaaatgaagatttaaatgatttggcaagaaaggctgaagtgactgcatctagcgcgttaaaagaaattaatacatatgcggtagatatggatccgtatccacttgataaagcggttgccttcacattgcctgtagatcctaatattaaagaacttaaactccttatttcaacggccaaagcaacagaattaaaagttacttggtatagcacaggaaaaccacagaattatatcccagattctaaaattgatgagcagacaattgaagttgaagcaaactttatgggatggaaaacaattaatattgattggcaaccagaacaaccacaaaatatttttgtgatagtagaaaaaaatgaaaattgttctgtatatctggggcatcaagaatttgccggtgttttaagctatgtaaatgatccaattcaagaattgagtcagccagaattacatgactattcacgtaaaagtcctttgttgtattggactaatcaatcgattaatcgtcggaactttgtttttaaagtagaacaaacggaagcatattcagcagaaaaaattattaatgggtatgtgagaccatatggtggccctaatatgtgggtgactaatttcagaaataaaccagaagaaattcaacttacttggacgaatccgcaacatataaagcaaattaatttaacttttaatgatgacgttaatgaagacattattaaccttcatcatcacaaaacttactttgaacaggttcctgagttaattaaatcttatcgagtgtactatcaaagtgaggatgagtggcatttattatggcaaacagattctaatcgagaaagacatattgtccaaaaattagatcaaacgattgagactaaaaaattaaaatttgaattattacaaaccaatggtagtcaacaaatttcattaaatgagattcgagtttattaaggaggtttactatggaaagtagtcataaaaaactatctaccaatatgcgctatgttattttagcgttagtattcattaatatcgtaattaattatatggacagaaccaatgtttcaattgcaatgccggaactttctaaagaaattcatttatcaacggttcaacaggggctaatcttttcagcatttggttggatttatgctgcaatgcaaattccaggtggtattctattagataaatttggttctagaattatgtatttcatcagtctatttggttggtccttagttactgtttttcaagcctttattggtggctttggacaattaatgggactgagattaggagtaggcttctttgaagctcctgttatgcctgctaataatcgagcaatttcttattggtttccagaagatgaacgaggttctgcgatcggtatttattcatcggcccaattcctaggactggctttttctacaccaattttatattcaattcataatacaatcggttggcgagggctgtttattgtcacaggaatcattggaataatttggtcagttgtttggtatattttatatgctgatcccaataagagtcggtttgttggtgatgacgaattagcatacattaaagcgggcgacgcgatttccgaaggtgatgatgcacagtcaaactctaatacaaagcaagaaaaaacaaaaataacatgggaaaatattaagcaattatttacacggcgtttattaggaatttatattggccaatttgccatctctggaacattctggtttttcctaacttggttcccaacatatttaactaaggctaaacacgttaacttcttgcaatcaggtatgttatcgtccattccttatttggcagcgttctgtggagttatcttagctggttttatgtctgataaattattgaagagtggtaagtcagcaagtttcgcacggaaagcacctgtaattactggattactattaaccttattaattttaggtgctaactatgtaagtagtcccgcactaataattatgtttatgtctatagcattttttggaaacggtttagcgacgatcacttgggtgtttgttacagcattagctcctaaacatttaattggtttagccggaggaatttttaagggttgtggagcattatcttcgatagtgataccaattgtgattggtttccttgtatcaaaaggtaatttctcatctgcgttaatttttattgctgctatcgcattagtaggagctttatcatatattttagtagtaggaaaaattgaaattaatgaagattaggttaacagattatgaattgaatttttatataagtttgctagatattattataaccaacaaccaaaaaacacattctgcatattttcagaatgtgtttttgttttatttaatccttctaccaatgaaacgccacctgcacccccataattaacatccgcactccaattgttgccagaatcaatcccatcaacttcgtaatcacgttcataatgttattacccaatttagccataatttgttccccgtagataaaaatgaaataagtaatgaccgatagaacgacaaaagcactaatcacgatgaaggggttggtactactcgacaagttcatagtagtggcgatggttccaggaccagccagcaccggcatagccagtggagaaatcgctacgtcagtattattactgttaatggaatccttaaccgattgcttgggatcatgctgaataggggacacgttcccttggatcatgtgataaccaatcaaacctagaatgattccacccataatccgtaaagctgaaagattaataccaaagatactaaaaatgtaattacctagtagtgcaaaaagtgccacaatcacggtcgcaacgatgaaggctaagcgcgcaatggcattgacttcttttctactattatcagcagtcaaactcacaaacatgggtaagttagcaaaagggttcataattgcgaaaaaggcggtaaatgatagcaagaaagcttgaactaaattcatagtgcacctccgttaattaagttgaattagcttaacttaattatatgggggaacgatttaaaacccaattaatatggctggttaagaagggaaaagcggtctttaaagacgaatttccaaaaatactcgatttttataaaaagagcttgtatttaactaaacgtgtataatataatgcttgtgaagatagatagcattagccatcacttatctatatttatgcgtttttatacatactgaatgctgggactcagtatgtcaatatccctaaaggcgcccttaattacgaattatagtattaatccaaaatagaggaggctaaaaagtttacataaaaataagacttttatatattatgaaaatgtttacaacgtataaataagagtcattagtaacattggaattattgatgattagattagttgtagtatcggggaagcagattaaaaaaggggtattaataaaatgaagaaaattattttaagtgcaatgttatgtggtggtatgttattaggtgttgccaacagtggcgtggctcatgcagctgataagctaaccgggaatacaaccgcaactgctacagttactaaaggtgatgtcacgttagacattgattctgcaatcaattttgatccacaacctttaagtggggatgtaaactttggttctcaagatgttaactataaagttacagattattctggagatactaaaggataccaactatctgctaaattaggtgacacagatgcaactcgtacggtaaaaattggtgacacgacactttctgatgctgcagccgtagtagcatctaaagattctaatatcgtcggggaaaacgctgataaattatctgtaagccttgaatataatggaataaaagaagtaaaggattatagcactgctattcaatggaatttaactaagactcaaacagaacaaattacagaatagcaccattattccgaggagagacttagttctctcttctttttttgaaaagagatcgatatgaaaaaaatattcacgttggtatttatatttgtaatcagcattctaactgcgacgaatgtacatgctgatcataaacttgctagttattcagtgacacccattttttcggaacatcagacggatggagccgatagctattttgacatcaaatggccaccagctagtaaggaatcatttggtattaaaattacaaataatactaaaaagaccaagcaatttgaaattgaagtgaacaaagctcggactaatcgtaacggcattgttgactattctgatcatactccggaaaaagctaatacggtttacaaattaactcaaatgattaggttacctaaagaagtcgaagttgctcccaatagtagccaaattattcacggcagcattagttttccagctaaagatttcaatggaattttgatggctgaattacattttacggaaaaaacgacagcagtaaagaaaaatacagtttctaacacgattgcttataacattccgttcgtaatccgcggaaatcatgaccaacggcccacaccacgtttatccctgaaccaattgaagatgactaaacctaacttgagtacttacgaattagatgcaaagcttaccaaccatcatcaaaatttacttaagagtgtcaaaacagtttcgaccatcaaaaatatggataacaaaaccctcaaaaaggaaactaagcggattgacattacgcctgaaacaacttttgagaatcctatccaagtacctaaaaatataaaagcaggtcaatacaagcttgttttgaccatgcaacatggaaaagatcattggaaatttgaaaagaacttcaagattaagccagctgatttgaaggtcgctaagcgccatcagattcaaaatcattcggccttattcatcggactggcggtaattgcgctcatcgtaattggcattggctggattatattcaagaagctaaaacgaaaatagttttttaacccaaaagaaggctcgccgttaagcgaaccttctttttatttgtcgtctttatgcattttatctttgagttcttccatggcgccttcagctgattccttgacgtctttaagcttatctttgactttaccagtcatattttgagctttacctttagtttcttcttttttgtcgccagttactttgccggcaccttcacgaactttacctgtaactctatctttagtattttccaatctttcgttatcagacataaaacaatacctcctaaaagttaagttttttggttcatctccattgtagcaagtccaccatctaaagtagtaatgatatgctcaacttgagtcgatggacaaaaagttgtatcatgaaaccgaatttaaaatttaataaatatctgcactaggggtgttcttagaagaactgagatacgcttgttcagcgtgatccctttgaacctgtaagttagtacttgcgaaggaaagtgtttaattgttgaaaccaaaaccatccttctgtctataaaagggtggttttttcgacattaagggcagtgatagatattggtaaggagcttattatgaaccttcaagatattgccaaaatccgggaagttaatccggtagtagttaattatgctaattttgttaccccatttttggtggcgaatggcttaaatgcggtgggagcttctcccatcatgagtgatgaagtcagtgaagcggaggaacttgtccaactcgcatcggccgtggtggttaatgcgggcgcttctcgtaaagagagctggccactgatgagtaagctgtgtgaagcagctaatcaatatcaaaaaccactcgtcttagatcccgtcgcagtcggtgccacccagtaccgcaaagccctcaatttgatgttactagaaaaatatcatttcgatgtgattcgtggaaatatcggagaaatcgccgttttagctggtatcgattggcaaacgcgcggcatcgacgctggaagtgggaccgaagacatgagcgcagttgtccaagcttgtgcccagaaatttaacaacgtggtgattgctagtggtgaagttgattatatcagcgacggtcaacaagtgattacggtgcacaataacactaagttgttaccagccatcgtgggctccggcgatttattatccagtatcgtaggagcgttcagcgccgtagctgaaaatactttagatgctgctgttaccgctagtttggtactctcttgtgcgggagaacgcgcagcggcgcaactcgatcaacaaaatcgaccaggtagttttttgtcctatcttttagacgaattagctaatatcacccctaaacaagttcaagaccttatgaaaattggagaagcataaatcatgaaaagtaaattagtacctcaagttttaaccatcgccggcaccgatagtggtgggggcgccggcattcaagccgatatgaagacgatgcaggagcgtcacgttttttcgacctgtgtggtggtggccgttaccgctcaaaacacgttaggcgtgctagatgtagaagttatgcccaaacgaatgattgaccaacaatttaaagccttggcggaagatctagatatcaaggtagccaagactggcatgcttgctaacaccgcggtggtgaacgccgtggtggaaaactatcaaaaatacgactttggaccactcgtcgtcgatcccgtcatgattgctaaagggggcgcaaagctcctgagtgatgatgcgattgatgccgtgcgtacccaactcgcaccgcttgcttacttaatcacccccaacttaccggaagcagaaaaattagctgggatggaaatcaaaaataatgccgatgtgaaagaggccgctcgtcgcctgcaacaactcggggttaaaaatgtcttaattaagggcggtcattttagtgatcaacctgaaagtcgagattacgtcctatttgaaaatggcgaagaaatggaattgacgggaccccgttttgaaacgaataacacccatggcacaggcgacacgatttcttccgtgattgttgccgaactagctaagggagcatctttgaaagcagccttgcgcaccggtaaagcatttatcaatgcggcgattagtgatggtattcaagttgggcatggacatggtcccttgaaccattgggcttatggcgaggaagaacaatgaaattcaattcagatatgttaaaaatttattttgtggccggcacccaagatgttgctaataaggcggacttcttacctaaagtggaagaaatcttacaagctggagcaacggcctttcaactacgggaaaagggttataacagtatcgataatccagctgaattaaccgaactggctgaaaaatgccatcagttaacccaaaagtatcacgtaccgttgttcattgatgatgacgtggacttagctttagccattcatgctgaaggcattcacgtgggtcaaaaagatgaaaaaattgagtcagttttaaaacgggttcagggttcgatgattgtcgggttatcttgtaacaccgaagcgcaagtcaaacaggctaaccaactcgatggaattgattatctgggaaccgggacggtctttgaaacgatttctaaagccgacgcgggtgctgcactcggtgtagccaaactccaagaacttgtcgaactgagtcgttatccaatcgtcgccatcgggggtatcaccctcgacaatcttccccagacgatggccacgggagtcaaaggctttgcggccattagtatgtttacgcagatgacggcggtgtccacccaaatgcaaaaaattaaagcgatcgttaagggatgaggaggaaagttatgttttcagcacggttaaaagcaattgctcaacccgtcctcgccgacattgaaaatcatccattcgtgcgaggaattcaagcgggcgccgttccggcagcggccttaatggtctacgttgaacaggatacctgttttttagatgccttcgccaaagtctatgcgggcgccctttccaaatgtactactaaagatcagatgcgcttttttgaggaacagattcgctacactttaaatgacgaagctggtgcacatcaaattctatgtgacatcgctggtcaaaaactcagcgaccatcaacatgccgaacagcgaccaattacctacctatataatgagcatctttttaacgctttacgaacgggagatttaatcgacttaattgcggcaatgttaccttgtccttggacgtatactgaaattagtcagcaaatcgtgaacggagcagcaccagataatcccttcttaccctggattgaattttatcaacctcaaccaggtcaaattgatgacagcatggtaaaaactttatttggtatggttgacgaattagcaataggtctcagtgaggaacgccaacatgaaatcgaacaacgtttcttgcgaagttgcgaattagagtatgaattttgggaacaagcatactatcaaaaagattggaaatataaaaattaggccaagcgtgttagtataaaagtaaataggtgacgaatttaagaggaggtgacttaattgtcagactccttttattatttacccgtcattaacaacccagagagaagaagaggaattacatgaatccacaggcagttttgaaatcaaattttggatatgatgcgtttcgaccagggcaggagcaagccatcaacgcagttttggaccaccaaaacgttttggccgtcatgccaacgggcggaggaaaatcactgtgttatcaaattccagccttgatgcaggcgggactaaccttagttatttcgcctttgatttctttgatgaaagatcaagttgatgccttagcagccaatggaattgacgccaccttcatcaatagctccttagattatgcggaaatcaacgagcggtttagtcaagcgcgccagggtgcggtgaagctgctttatatttcaccagaacgcctcgattccgaatactttgatcgtttagcagaattaccgattgatttaattgccatcgatgaagcccactgtatttcacagtgggggcatgattttcgaccgagctacctaaaattaacggatatcatccatcatcttccaactcgaccaacgattatcgctctcaccgctacggcaacaccccgagtagctgaggatattaagcaacgcttagccatccaacaggaagttcaaactggctttgctcgacctaacctttcatttaaagtcgtcaaggatcaagacagtgaccgttttttgatcgactacttaaaattgaatccagatcaatcgggcattatctacgccagcacggtgaaagaggtcgaacgtctccatcgccttttaactaaaaagcatttccaagtggccatgtatcatggacaactttcgaaagaagaacgtcggcaaaatcaagacgactttctgtatgatcgagtgctagttatgattgcaaccaacgcgtttgggatggggattgataagagtaacgtgcgctttgtcatccacgaccagattccgggcagtatcgaatcctactatcaagaagcggggcgtgcagggcgagacggtctaccgagtgaagccatcttgttatacaaattgcgcgacgttcagattcagcactactatatcgaacaatccgaacgagacgaagccagcatgacgatggaataccaaaagctacaggcgatgagtcagtatggtaatacgcaaaagtgtttacagcgctacattctaaattacttcaatgaggatgctccagactgcgggcaatgtagtaactgtttggatacacgagctctacaagatgtgacgattgaggctcagcaagtgttgtcttgtatccggcggatgggggaacgatttggaaaagaaatggtcgccctcgtactgacgggttcgaaaaatcagcgggtaaaacagctgcactacgaaaagttgtcgacatacggtttaatgcagcagcggaccaagaagagcgtgaccgaattaatcgattttctcacagcggctggatacatcgccccagacggcggccagttccccgtcttgaaaatcaccgaggagggcttacgcgtccttttaggtcaacaaaaagtggctcggaaagtggcagttaaggcaaataagtctttaccagaaaacgatgcattgtttgaagaattgcgggcgctccgtcgggaactagctgaaaagcaaaacgttccaccgtttgtcatcttttctgatcaaactttgcacgatatgtgtacagttatgccagacacgctcgatgaaatgttagacgtaaaaggaatcggggaaagcaaactccaaaaatatggcgaacagttcttccaaattttacgaaattatcaagaagcttagtatttgttaaagtgctgagctttttttgttagaatttataaggataggtataaaatgttgctactgccaatgagtgaggagaatgctacttgcgaatcagaacactgctaacctggttgttgcttttcttgggagcaacgtgggtcattaaaaataacatagtccagataccagataatgtgcaacagacatttcgaaacggagttagtcgggtgacgactaacttaaattcgattttggattcaaactggaattttaatcagaacaagacgtcgaccaaaaaggatgtcagcgacgacgcaaccccggtggaatcgattgtcaaaaacaaaaatttatcgaataaatactactacagttatcaagcgggaactcctgatgctgtccagaacgtttttaagcgtgccattgcgacttacaatgccacggggattgttaaaattgttccaggagcggaacaaggctggctaaatcatttagagctgggaacctatcgtaaaaatgtaccgctaaaccaatcccgcacgattgagctagggattggtgggccaaaaattatggaacaaacgggcgtagttagtcgaatcgccaaccatgcgtccgccaaactcaacatttactacaacaaagccgtttcacaagccgtcgccacccatgaagtcgggcatgccttgggcttagaccacagccaagctgaggattcggtcatgtacccgttggatcgcgagcaaacggctttatcgccagccgaccttgcagggttaaaatcaatttatggagaaactaagtaagagctactaatgcaaattaggagctcttttattttgttacaaaacattacggcaatattacaatatggagtaaatgcccgataaaaaagcccgttttcgggttaagacgttgaaaatttatagattaaatgatagatttaattgtgacttattaaaaatggagagatactgtatgaaaaaaacactaacgtggttaggagtggcggttggttcgttagccgtttttgctggtgcagggttcggtgtaaccttggtcaataaggactcacttgctacacatatgattgcaaagtacacgggaaaaagtaatacttcctcaagtagttctagtaccacatcttcttcagtagaagactcagcaactttaaaagttgctaagagttccaatttagattcgattttaaataatggtgaatataacggttcagcagccttagcgacgggtaagaagattcttactagctcacgaggctatgctaaccatgctgctaaaaatgaaatgacggcggatagtcaatttttagtaggaaaaatccaagatacgattaatgctgggattatcatgcatttaatcgatacaggcaaagttaagctcaccgataagctttcaaaatatgacagcgaagttgctggagcggaatccgtgaaagtcgccgatgtgatgaatcaggcttcagggattacggcggataccatcgctagtagtggtaagactaagagtttagtcaaagaaatcaacgaaaatgcgtcctatgattcgacgatgcaaggggtattcgtggactccagagccaataccatcttacaagcggccatcatcgaaaaagcttccggcgaatcttaccgttcggttgtcagtaatttgattgatcagttagagctagctaataccgcttggggaatgaaagcgaagactgtcgattactaccgggtggatgatgtaggttcagcatcgaaggtaagcaactcaactttagatacagcggaacttaaccgcttgggtagcgatcaattggtgagctcgccagccgatatcgctcagctgtataactacctatttaatagtgattatgtttcaagttcgactttagataaagtcttcgatcagactaacggtcatgtggctggttttgcggttaatggggatgccttaagccttacccaagccgtgggtggcggacgaaaccgtatcgaatggaatcttaagaaacagaccggaacgttcctatttagtaattacatcaatggggaaaataacttgtcatcaatttcgaaaaatatgtttgattacctaaaataaaccttggaggaactcatggaatcagtagaatcacaacaaattagtatcggccagattttgtcgatactacgtaaacacattggattaatttttgctagtacgtttatcgtaactttgttagccgcctttatgactttttttgttatgacaccaaagtacagtgccacgactcaaattttggttaaccgtaaattgtcagagaatatggcgggagcccaattgcaacaaacacaggccgatgttcaaatgattagtacatataaagatatcattactagccccacggttttgaagacggttaacactaaattacaaggtcagcctggctatgaaaagggtgatgttgatagtttaaagagttctctttcagtcaatagtcaacaaaactctcaagttttctccatcaccgctaagagtaccaatcctaatacagcagctaagatggcgaacgaaacagcgacaacttttaaggacaaagtagctaagattatgagtatcaataatgtttcgatcgtttcgaaagcgactgcggatgaccaaccggttagtccacgaactaagttgaatattgcagctggtttggtagttggtttactcttaggaatcggattagccttcttacgtgaatttagtgatcgaaccgttacctctgaagaattcctaaccgatgaattaggccttaaaggtttgggaattattagtgaaatcaatgaaagtgatattcgtcgtaaaatcacaccaaaacttagagcaccaatgagtgatgatgacgatcaatctagaatgcggagaagggtataggtaatcgaaatgtttaagaagaaacaaaagctagataacgaaagtcttaaaaatggtgtgggattagttacttttactgatccgacttccacgattgcagaacaatttagaaccgtacggaccaacattcaattttcatcagtcgataaggctttgaaatcaatcgtctttacttcatccgcatcatcagaaggaaagtcgacggtaagtaacaacgtggcggtcacttgggcggatcaaggtaagcgcgttttaattgtcgatgccgatatgcgtcgtcctaccgtgcatcgtacctttagtgtcagcaatgcggttggattaagtaacctcctggcggagactggcagtttggaaaacgccatccatgaaacaattattaataatctatcggtaatgccaagtggcccaatcccacctaatccatcggaactattaggttcggccaagatggccaccttattggatcaactaaccgaccattatgaccttgtgattattgatgcgccacccgttaatacagtaaccgacgctcaagtcttagcagcgcgtgcggatggaacaattttggttgtccctcaaggaattgccgataaagccggggtgcgtcatgctaagcaattacttgaagcagttcaagctaatattctaggagcaatcttaaaccgagcaaccgctgaaaaatcaacaggttattatggtggttactatggtggttattacgggacggatgataaataatgatgaatttaattgatttacattgccatatactgccaggtgtcgacgacggtgccaaagatttaccaatggcactcgacatggcccgtgaagcagttaaacaaaacattacgcatattttattaactccgcatcacatggatggcatgtatacgaaccacaaagcagacgtgattcgtaaaacagcggctttccaacaagaactagatgcggccggaattcctttgacggtttttccagggcaagaagtccatttgacgggagaactgttagatgcaatcgataatgacgatattttgtttatggatgaggggagcaagtatttgttattagaattacctcacagtggaattcctgaatatacggaaacggtaatttttgaattgctagcccgagggattacaccggtgattgctcatccggagcgaaatcatggttttcaaaaaaatcctgaccgattgtacgactttgtagagatgggatgcttaactcaactaactagtagttatctgggggtattcggagaaaagatagaacaattgacgcaaaaaattattgatgcgcacctaggctttgttttttcatccgatgcgcacaattttgaaggacggcgttttctaatgcaagacgcttttaataaattaattaaagaaacgacagatcgaaaagctgggctgtttaactataatgctaagtcaattgtaaatggggattcaattagtactaatagcattctgcacttgtcttcactaaagacaaagaaaaagaaaaagttttggctattttaaaaattggaggaagtttatcttgaagaaagcattaattacaggtggagcgggttttataggttctaatttggcagataagttagtggaagatggatatgatgttacaattgtcgatgatttatccatgggactaataagcaatattccagattcaaaagatattcatttttatgaaaaatctattacagattacacttttatggagaaaattttaatagagaacaattttgactatatttacttattagctgctatagctagcgttgctgacactatagaaagaccgtattcttctcacctagttaatcaagaagcaaatataagaatattagaagttatcagaaaaaataacttgaaacctaagagggtcattttttcttcatctgctgcagtatatggaaatgaacctacgttacctaaaaaagaaacttcatcaatatctccagaatcaccgtgtgctatcgataaatttgcaaccgaaagatttgtcataaattacggtaaattatatgggataaatactgctgcgacgagattttttaatgtgtatggacctaagcaaaatccacattctccatattcaggagttatttcaatcattagtaagagcttaaaatcgaaagagacctttacaatatttggagatggtgagcagactagggattttgtttatattgatgacgtagttaatgctttaattattttgtctaataacgatgatgctatacataatgtatataatgttgcaacagggcactctgttacgttaaatgaaatgataaatgtttttgaaaaaatatctggtaatcatttgaatttaaagaaggataaagaacgcgtaggagatattaaattttcaaaagctgacgttaccgcacttataggattggggtattcttctaattttgatataaatgatggattaaaaaaatactgggaatcattataaatacgggagagaaaaaatggcaagcaatattttaaacgatttggaagaaaaagttattgatatagttaatagtaatgttgaaccttacgaaggtaacaactatctatatgtaaaaagagcgttggacattatattttcgctgattttacttattattgcaattccatttatcattgtttttgcgattgcaatacgtatagaaacacccggaaatcctttttattcgcaagaaagggttggaactatgggtaaaccaataaagattactaagttaagatcgatgtatagcggcattgaaaagaagtctggagcaatgtgggctcaaaaaaacgatgctagaataacaaaagtcggaaaaattatacgaaaaacgagaattgatgaattaccacagttgctttcggttttaaagggcgatatgagtctaataggacctagaccagaaagacctaattttgtcattcaatttagtgaagaagtccctgggtttgagcaacgtctaagaattaaaccaggtttaagtggatgggcacaggttaatggaggttatgaagattctcctgcaggtaaactaaaaaatgatttatattatataagtcacttaagttttaaaacagattttatggtttttttgaaaactataggtgttgtctttactggtgaaggagcaagatagaatggaatcgagcaaaaattctttagatagctatagcggattgatgtccgtgtatactagagaaaaggctgacagatttgagaaagcaattgaatctatatttgcacaaactgttttacccagtgaatttattttagtcgaagatggaccgttgaatagtgaactaattagcattatagaaaatatagaaaaagaattctcagccagaaaaattaattttattaaagtttgtaataaagttaatcggggattaggctattccctgaataaaggcttaaattatgcgaattatgatttagttgcaagatttgacagcgatgatattaatagagctgatagactagaattaactttaaaggaattcaaaaaagatactcaattggcgatggtaggcggaaatataagagaatttgatcctaaagatgatgccttttcaaaaatacgtaaggttccacaagagtttgaaaatataagaaaaaatatcgcaaaaacaaatccttttaatcatatgacagtaacttttagaaaaaaggacattcagaatgtaggtagctatgaagatgtcccgtattttgaggattactacttgtggtttaagttgatagaatcaaaacgaagggttataaatatagacaaagttttggtagatgtttgtgtagataacgactttatttttagaagaagtggtttccaatatttaaagaaagaaatattctttcaaaatttattgtattctcacaaatacataaacttagcacagtatatgagaaatatcctattaagaggaggaagcagattgcttcctaaagtactaatcaagttaatttattcaactataagagaatagtaaagttattggagatattatggataagcattttaaaatagactttgttattacatgggttgatcagaatgatagttcttggagagaaaagataggtaaatataaagatggaataagcaactctgcgcgcttcagagactatggaactttaaaatatttactacgctctattgacaagtttgctccatgggttaataaagtatatttggttacagataaccaaattccaaaatggataaatttagaatttgaaaaattaaaaatagttgaccatcgagatataatcccagaagagttactgcctacatttaattctaatgtgattgatttaaatttagtcaatataaagggattgtcagagcattttgtttattttaatgatgatatgtatttaaataatcctgtaactccaaatgattttttcgatgattatggaaaaccaatggacacgtttggatttaacgtaataatgccaactgaaaaatttgatcacacctttgttaataatatagctattattaacaaagattttaataaaaaagaaattatcagaaaaaacttttttaagctattcaatattaaaaataggatatataattttacatcagcattattagctcctttcccaagattcacaaggtttatagatccccatgtacctatttcttttagaaaaagtacaattaaaaaagttaatgaaaaacatgaagaaattttaagatacacaaagcatcgatttagggatatagaagattactctatttggatatataggtattacgaattagtggaaggaaatttttctgttagaaatagtaattttgtaagaggaattcaattaagcgatcttgaacagaagggaatcaatataatacgtggtaaagtaaaaataatcaatattaatgataaagatgatataagtatggataatttcgaaaagttgaccaacaagcttaaattagagtttaaaagaaaatttagtcaaaaaagtaattttgaaaagtaggagaaaaaatgtctagagaattatttactcgaaaagaagatagtaataaattgtttatgaatttatttaccttaaatattttttatcaaatactttcgaatagcttgcttagagaaatttatagtagagcacttttttcttatgtaggatacggattaatagtaattcttttcttcgttggtatattaaatggattgatacatttgaatagatatagagaaattatcaaatttttcttgctattgacactaatcatagtattatttgtccaaaagaacacttctattctattcttagtggtatttgggtttattgcaagttatctttcaataagtgaagttatggaatgttttttttctggcacaatctgtgctgttcttcttttattaattttatgtgctttatcaatagtaccctatagagatgcttacactggtaatatacaacttggttttagcaatcctaatacaattggattctattttggtcttatcccaatggaaatgtttttcctaagaaaaaataaattttctatactcttaatgagtataatttcttttgtggctaattttttcttgtttcaagattatacaatggttttagtattgtttatatttatatttattctttacctaggtaaagtttttccacggttactttttagtaagactgtgaagttaataacaattttattgccatatattttaacaagtttatccatatatttagcaataaattttacggtcaatccgttgatgtataggataaataatatgctgagtaacagattgtacttctggcaagaatacataatggcttttccccctaagctcggttatcaagtaacaaatatgaatcaggtatatcctctatcatttaatgcgaagtggccttttgatggatcctatatttattatttagttacttctggatatgtgacctatactatttttctcatagtgacaacagtagctatatactactttttcaagaaaaaaaatgttgctctaattgcattaacagttgcttcactggctatcggattttctgagagtttgcttttttcattttatcagtctccgtttggagttcttgccgtagcaattgttttatttaagataccttttgaaaagagggagaatttatagaaaatgaaaaaaatattattgacaggtgttggagctaatatgggtggaacagaaacatttgtccaaacactagtgaaagagttacatcataatgccaattttgtagttctagctgcttctaaaacggaggttgcagaagcagatttttttaaaaaatataatgtaagagttgtttatttgaaaaacattttcggatttaagagcattttaaaaagacccagaattattgagtcttttttattaaaagaaaagtttgatattgtgcatataaatgctactagcctaaatgctgcatacatagcaaaaaaagcggataaattaggtgtaaaggttatttaccaagtccataattattcgccatcgggttatggggttgttgcaaaaagcttaacaactttattagctaagaataatagatcaattttaaaaaaataccggatataaagctagttgctgttagtgaagaagtacaagaaaaattatttggcaagaaaattaaaagtgaagttattcttaatggggtagatagtgacgtatatgccttcaatgaaagtagacggcgcataataagagaaaaatttttgatttcagaaaaagaagtagtgggaataatggttgcacggatgacgccaataaaaaattatgatagagcagtaaaaatagcgacattatcaattgagcgaggcgtgcttgatagattttatatggtaggcgatggaccagaacgtgaacgtatccagaagttgatcgatgaattgcctagtaggataaaagaaaacatgtacgtcatgggagaaaggaacgatataccggatctattaactatgtctgatgttatgcttttgacatccagtaatgaaggtctatctttgagtgttatagagggacaagctgcggggttaggaatagttgcttccgatggagttcccccagtgactaacattacaggtaaagtaatttacattagtcttagagtagaagataaggtttggacagacgctattgaaaaaatgagtataaacaattttactgatagaataaagagtaatgaatatgtcctaaattcacaattttctaagaagatatttataagaaaatttatagaattatataatttataaatgggattggtacgatgaatggcaactagaactttaaaatctataagaaattctaatacggcttttgtgggacaactggttattttgatagcgcagtttataactcaaactgtatttgtaaaagtgttgggatctgaatatcttggtgccaacggattatttacaaatattctaactttgttatcctttgcagatttgggtataggtggagctatcacgtatgcgttgtataaacctctagcagaaaatgattataatactatatcagcaataatggagctttttaaaaaaatatataatattattgggtgcacaatatttgtattaggtacttttttttctttctttattgaggactttataaacagtaacaccacgattcctcatatacagataatgtttattttatttgttttaaattcggctacgagttacttttatgcatatttaagatcattattgattgcggaccagcaaggttacattgacgtaataaatagagttattttcacaactatacaaacagtattacaaatcagtttcctgttacttttccataaatatgtgttatttttaataattcaaattctatgtactctgtctgctaatatttcattgtatcgtaaaacgttaaaagcatttccttatttatatacggaaaaaagtaaaaacataaaaatttctcctaaaattatagaaaaaatcaataaaaatgtcgttggagctgtggcatctagattgggaattgtagttgcgaatggtacggataacttaattctctcaagtttcattggtttatctattgttgggaaatatactagttatatgcttatctttaacagtgctcaaaatatagtaaatcaagctataaattcggtgatttcgagtatagctaatttttctgttgaaagagaagggaaaggggagagtactcttttctttaattttcaatatgttgtatttggaattgcgtatgtttgttcatcagtaattttggtgatagtatctaatttcattactttatggattggaaaattttacgttctaggtaatattaccacgattttaattatagttgtgtggtttataaatataagtagattaagtgtgcaagcatttattaccgcacatgggctttattgggaaacaaaatggaaatctattattgaagctatcataaatttaattgcaagtttatgtttaataaaattcacatctcttggggtgaattctgtgatacttggaacgcttatatctatagtttttgtgagtttatggtgggaaccaatggtattatttacgtctgtaaagaatatctcgttacttaaatttttatttaaatatttaagcctaatatttattgagagtattacaatcttgtttattttatacatgaaaaataagttcgcttttcttcaaacctcatcaattgtagatattacattgcagactatttgtagtggtattatatttactttgttttatttagcagtaaatattttttctactgagcaaaggaatgttatttcaaaattatgtaaaagtctaaaaaaaagaaaacaacatgttcataaaaattaaaattatatccctctcgttactataaagatgccctataagagaagtaaggaaagttgccttcttatttaaagaagctttgataataaatatatatatacgataattatctggtttgtgtataaagtggtgactatgccagttaaatagtaaaatatttatataatgaggtttaaatccgaaatttaatggctctagatcaataagtgtggaagaagataagtgaagaaaacaattcgtaaatgaattgttttcttttttattttaaagataaatccgatgtatagatgacaaatggtagattgcaaatttaatccgaatttttggacaaatttgtcagcataacctgatacggtatatttattttaaaaaatcgtaaatcactagctaactagctactattcctgtattcacatcccttggaggtgttattttcatcgctcttaagcccaatatattgaaaataaaaaagattgagccaaaattgactcaatcttttttataatattattttactcgagctaagaaatacttcttctttccccgacgtacaattacaaacttaccatcaaagttacttgcagggtcgatttcagcattaacgtctgttactttttctccgttaattcgaatagctccattttgaatgtcttcccgagcttggcgccgtgatgattcaatcttagtggtatcaactaaccaaagtacaatgttttctttcttattttcaacatcaacacttggcatattcttaaagccttgttcaatttcactagcagttaaatcttttacttcacctgagaataaagctgctgaaatatgttgtgcttcttcaaccgctgcatccccgtgcacaaatgaagtaacttcttctgccaaacgacgttgtgcttctcgtttttctggagctgttttaactgtttcagccaaacgttcaatttcttcatgacttaagaatgtaaagtacttcaagaatttaactacatcccgatcatcttggttcaaccagaattggtagaattcataaggagtggtcttttcagcatctagccaaacgttaccaccctcggacttaccaaacttggttccatcagctttcaataacaacggaatagttaaaccataaacctttgcttcttggccttccgttcggtgaattaaatctgtaccagctgtaatattgccccattgatctcctccaccgatttgaagttgaacatcttcattcttatatagatgtaaaaagtcaattgattgtagaatttggtatgtaaattctgtaaatgaaataccaacttccaaacgacttgctacgatatccttagctaacatcgtattaacgttaaataatttaccgtaatcacgtaaaaagtctaacaaggacattttagaaagccaatcataattgttaaccattcggaaattatcggttccaaagaatttcaccatttgagacttcaaggcttcttcattatggtgaacctgttccatggtttgtagaactcgttctgcttttttacctgatggatcaccaatcgatccagtcccaccaccaattaaaataactggtttatgacctgcttgttggaatctcttcaaaaccatgaaaggaattaaatgcccaatatgcatactatcacccgttggatcaataccagcataaagcccaatcttcttttcgtctgttaactttttcaagccttcttcgtctgtttgttggttaaccgcaccacgccaagtaagttcatcaataatattcattttcattcctccaattttatcgaccatcttcaattagaaataaaaacgtccccaatcttaataaattaagatcagggacgaatttttccgcgttaccaccttgattgagtatcaatactccgctcaacatcgataacgagatgatccgttcattaaatgaaagctccatagtgtaattcgtgtcattaataagtctgattcgcatccccaccagatttctgtttgcttgcttaataacctactatgctacttcaaagcttcgttattggttacaattttacggatattcaaaacgactgtcaaccttatttagctaactcataaattgcatgggcgtagataacagcagcgttgataatatcatcaatttccatgtattcattagcttgatgcatgacattttcacggccagggaactgggccccaaaggcaacaccgcgatctaaaattcgaccgtaagttccaccaccaatgaccgtttcttcacccttttcaccagtatgttcttcgtaaactgaaagaagtgttttaaccaatgggtcttcaccggatacataatgtggtacttgggcgtgtccatgaatttccacttttgcttcaaaatccgaaagggcctcagttgccttttcgataatttcatccgcattcgttgattgagggtaacgaacgttaataataacgtgattagtcttaccgaattcgtaattaaataagtccggtgtgaccgttaagtcacccatcttagcatcaatcgaattgattcctaacttatgaccacgtgaatctaaatgcatttgttcggcaatcatcttcaaatagttgctggctactttagtatttaagaaagttgctaaaaaggtagcagcattcaatcctgctttcggttctagcgcatgtgctgattttccaatcaagaaaaatttcaattcatttccatcaacggtaaattctcccgtcaatccattttcagctaaaaatgtatcaaattcagttttgagttcttcaacgtcaacttcatcagcaattacaattgctgttgcatcccgtggaatcatattttctttaataccactagtaaatgatttcaaaactaaatcgccttgtccatctgattgaggaagttcaattttgaaggaagcaatccctttttcaccattaataattgggaattcagcatctggagaaaaaccaaaatcaggagttttttcaacttcaagataacgattcataccaacccattcgctctcttcatcggttccaaagattaaacggatttttttagaaacgggcaacttcaattctttaatgatctgtaatgctaaataagcagccattgaagggcccttatcatcactaattccacgtgcataaattcgtccatttttttctactggttcaaatgggttagtttcccaaccttccccagcgggcacttcgtccatatgaccgagaattccgaaaatttcttcgccatctccgtattcaatatggcctgcaacgttatcgatgttcttcgttacaaatccatcttcctcagcaaaagccaacatcgtttccaaagctttacggggaccaggtccaagtggagcatctttggttgcatgttctgtatcacgtgagctgtcaatcttaagtaattccattaagcgttctaacataacgtctttacgactttgtacttcagcattccaatcaattgtcatctgggataccacctttatttttattcatatacattttttctatacggtagattatacagaaaaaagataaggatgtggagttccaccttttagaaggttaaagatttttcacatacttatcttcatttttgttactttttttgtttaataccagctcggcttatcaccatctgtattgggcttattaacaccgatagaatgcttcaactcggtattattttgaataagttccaccacgatgtgagcgatactcttccgagaaacttcagttcctttgaagacctcgcccttttgggtaacttcgaaatcaacttcgtcgttgttagttaaccaagctggacgaacaattgtatagtccaaatcactgtcctcaatcacatcagcggcagcccgataattggttatgtaactccccaatgttgaattattccattcaccaaacttaccaggtacctcatcgtaaattccaagggtagaaatccagactaatcttttaatctcaaccttatccatcgcttttaccaccgcttgagcctgttgtttaatatcgccaccagctaaattagcgtaaaccgcatcaactccctgcatagctgcgactaattgttctaagttagttgcgtcaccctcaattacgacttctcgatcgggttgaattggatttaaacggccagctttgcgtaaaaatagctttaaactgtcatccgttttttctaaaaattccttttctgccaaacgagcgatttttccatgagcgcctaaaatcaaaactttttttgtcataattatctacctccactattcattctacttgcttacaaaaaattagcaattataaacacttttacgtttaggtaataattttcaatatttttagctacaccttttttaatgaaaagcgacaaaaacttgccaaagggttactactgtacaaattgcaatcacaattaaatcaccaagaatggtttccatttccattactgcaaatttctctacatcttcgcttactttatcaactcgacgacgagttctgatggaaatccagcagaagtaggccacgattaaacaacaaaatggaactaaaaacaaaacatttttattcaccattccagctgaacttcctagagctgctggcacctcattttgtagcattggtgaagcgataaaggcaattagcaatggtaaaaacgcaatccactgaatccatttaaaccgtgataacgcaattccttgtaaccatgttggtaaattatcaatcgtcaatgtgggttttcttgaatctgcaatcactgcttgggctttttctgatttttgcgccgctgttaatttattttttcttttactcatatttaattcccctatctcttctcaatctacatttagcatagcagttccttggataaataaaaaatgcgggaaatgagcttaattaaactcattggccacatttttatttttagtgatcggcttatttgttggccatttgagcacgtttttcagcttcttgctgaagtgcttggcggtcagcaatcttgaagaatggatagtagattgctccaccgattgctaagttaactaattgaataactgcaccggaaatcttaccagttgcaaggtatccagaaatcaaaggtggagttgtccaaggaacagcaacaccaagtggtttaccaacccaaccgaacttcattgcgtagtaagtcgtgataactgaaatcaatggaacaatcacgaatggaatcgcaataaccgggttcaaaacaattgggaaaccaaagataattggttcgttaatattgaataatcctggaacaccagctaatttaccaatagctgataagttttctgatttagccaagaacattaacattaaagcaagtgataatgtttcaccggcaccaccaaagtgaacaaagttatcaaagaattgttgtgtggcgatgtttggaatagccttatgtgctttaacagcatcagcattttcagtcatctttcctaaccaaattggagccatgattccaccaacgatgtttgaaccatggataccaaataaccaaaggaatacaacgaagaattcagcaactagagcaccgaagattgatccaccaacgacgttcaaaggttgagcaacgattactgtaataacatttggaatcgtcttaaagtccgtgaagctaacacctaaacgaagtaaccacatacctaaaataataacaaaacctggaattaatgatgaaaatgcatgtcctacagcaggtggaactgtgtctggcatcttaaattgccaatttttatgaatcatccaaacgaatgcatcagtaatgaataacccgattagaagagcttcaaagagtcccattgaacctaattgtgttagtggtacccatgctgctcctgccttatctatattcaatggaatcgttaacataaatgaagctaaggaaaccatacttgcagaaagagcatcgattccttcatatgatttagctaattcatacgaaataccgattacagctaccattccgatcacactaaatgtagcattagtagcccagccaaccgtagtttgccaatctgcaccaaacaaacttgacatcaagtttagatatgcggggattgggaactgactaataatcatgaatactgatccaataatgatcagtggcattactagcgcaaaaccatcacgcaaagcaaccaagtgacgagatgaagcaacttttccggcaattggcattagcttttcagcaaatgcattagtcttattgttgtcactcataaataaaacctccctaaatttttattgatcagcaattacaatctgaattagtaaataattgatatgaccttaaaattactttcccaaaatattggaatcgctttcacaaatacataataacatttgtacctacaaattaaaaccgttaacacctaatttggaatttgttttttattatacataaaaaagttatggttaaaagctggtagccctattattcaagacattgatatccgactcttgttccataactttcttattttttctatttggtttcgagcatcttgaagtcactccaaggctgtaagctgtctaaaatcatagcatcttctttagcaacatgacctacaacattaactcgaccattattttctaaatcttgcaaagcaatttgtgtttcagctttgtactgggcatactcattattcatcactaacacgtcgccttttttaattggaacaggattgttagcaggcacatcttcatcacgataccaaacgcgggtcattgtgctacgtaaaacgtaatccgaatgatcgccacgatatgagtgttggctttcaaaaacaattttatgttctaactctgtcattgaaggagctggaatcacatgaaaggctggcatactcattttaaatgcttcggaagcggcttttaaatcttcttcagtaacaccagcattagaaattaagacatcatcaatcaatcctagcatcttcaaatgcataatttgtgtgaagagggtttgtccacgatgttcttccagtgaaaccatttcttcttggagtggccaaggaccgatattaccagaaggggcattaacaaaagcggcggtatttaaattatgcttccgatattgttcagaggtttgtttgaaatagtccaaccctaatcctgtatatctttgaggataaaaattatgtgaaccaatcaaattatcccggtttggtgagtaatccatgatttgatcaatatagtgcgttccacgactcatattaacttcgatttttaaatcataaggattatgcgtcattcgagcctcttccatccccgtaaatccttcatccagtcgaatggcccatgccccaatatcatggaaaaatttgaggttatcgtaggatacccctaactgttcaaacaaacgtggattgatatctaccatcgtgtccattcctaatgaatttccatattcaatcatatctttgaattggttcacgaccttttcttgatcacccttgatttgtagtagtgatgtaaaaatccgtttaaaaccatatttacttgctaatttaatatattttttggtttcctccacgcctacccggtctggatagattgaaatacctagtcttcccattaaaatttcctcctatttcattggtatacaccaataatgtattcgctttcagtatatcatctatgactaaaaatttcagctatattctgtttttttcttgtaaccgagtttgacgagtgaaccagcaccgtgatactctttttcataacctatactaaggacagtgaatagcacgatgacaaaattaattaattttttagccgagtatcagcgcgaaatcgaaagtcaacccatcgaattagacttagctttatttagccgtttggtcggactcccctttgaagccgtactaactcagccttcagcccctttagtggaagcttgcatgaaattaattgaatttgtagataatgaaaattacttgattttacctgctgatcgccaaatgttagaacaaattgcttttagcaatcgatatcaaagtgttcaaatatgcgatgtggtccaaggaccacaccgctttttagcggctacttttgttctttcaaaaaacactaaagtcattgcttttagaggccctaacggaaccttattaagttggaaagctgacctccatttttcattttcttccataaataagttaaaaatccaagcacaccaatatctcctccaagccctacagcacgataatcaaaacatctattgcgttggcttttctcaaggagcttccattgctgctctagcttgcatggatatttctgatacccatcgtcatcgaattcaaaccattatctttgacagtcccggattacctgatgaccattatcaaagtccaattcctattattgaattagttccaccgctgtcgttattcgcactagttggagaacacccttttcaccaaattaccattagcagctcttcaacagggatttggcagcacgatctttattcttgggaggcagattcacatggagcatttgctaaaaacattggaattaccaatcccacgactattcaacaccaatttattcaattattaccaagcaatattactggcgaaaatattgaccgtaccttgaatgttgctatcagtatttttagccaattaaatttccattccacttccgaacttattaaacattggaatcagtttaatgctctaattcaaactgaaatcacggtcgaaaatattgtagttaaaactgctattcttcgtctccaaaaattgatttttaaaaatgccgctttgaatctccagtcaattccattaaattaagtttcttaaattatggtatccttgaatcaaccatttatgaggagtgtgaatttaatgtcaaatgaatttccacaagctttaactatcgctggttctgattcagatggaagtgctggaatggaagcagatatgaacacattccaacgtcgtaacgttcatggaatgtgtgtcatgactgcctgcgtagccggtaactcttacggtattcaagcaagccacgccctacccaccgattttgttgatcaagaatttcaatctcttgcagctgattttaaaatccgtgctagtaaaactggcatgcttgctgacagtcccatgattgaaacagtcgttaaaaactatcaaaaatttgattttggaccactagtcttagatcccgtaattattaccaagcatggtgccttgttacttgaagaagaagctttcgaaactttaaagcaacaactcattccattggcaactgtgattactcctaatttttatgaagcaatcaaacttactggtattgatattaaaaatgacgatgataccatccaagctgctcatatcctacaggaaatgggtgctaaaaatgtgatgttgaagggttcgcacaaaccgggtgaacaaaccgaagttcgtgacttcgttctcttggaagatggctccagtttttggcttagtgaaccatacattgaaactgaccgggttaacggtactggcgatgtcctttcagcatgtatcactgctgaaatcgctaagggaactgatattccaactgctatccgtattgctaaaaaatttgttaccgctgcaattgccaacccaatcgcagtaggtcataagtatggacccgttaatcatttagcgaaattccaagcttaatccatttaaattaaaaacgcgaaacaaatttaagggtcaaggcccgcaacttgtttcgcgttttttatattagttttccgtatctttttcagtaacagtctgcactgccacatcattggcaccattatcagcagccgcatcggaatccgtagtggtagaattggcagttgaattattagccgtcgaattagcattcgaagtggtatttccagcattagccggagtgtagttactgccacctgtattacccgcagttccagtagttgctgccccaccagctggggtgttgttagcagcatccgtagtggtatcgactcccgtagtatctgcactttggtccgttgattgagtatctacactactttcttcactggaagacgattcatccatactaactgcatcagcatctgtagatgtcgatgcactattagccgcccactctgtatacgcgtctgaattattaataatagtaactttaattgttgaactagctgtatgcccactagccgttgatccaatttcaaattgaatcgacttaactttcttacctaaatgaacattgtaaactactttaccttcagcatctgccttggcaacttcggtttttcgtgtctttaaattggtaattttaacttctgccttggcattagttttaatattaattaaggcattacccaaagcattggttttctctttttttgtatctacttttaatttagttgctgttttttgaacagtatcctctttagttgttgtttctggcttagcattctttccacaagctgctagcaaaaataaggtcattattgaaactaaaattgtactaatctttttcaaagcttcatcctccaccacttcggttattaactttaattattacagtgtatttatcatcggtcaaacagaatttttcaaaatgcttgcaattgttttaaaatatccctatacttaagttactaataaaaagtaagtaactttaaaggggattttaaatatgtcaaattcattcttagatgcaattaaaaaacgtcgttcaatttacgctcttggtaaaaatgtttcactcagtgaagatgaaattactgatttaattaaagaagctatccgtcaaagtccttcagcttttaacagtcaaacggtccgcgccgtaatcctattcggtaaggcccatgatgaactatgggatggcattctagacattcttcatggtgaggttccgaacgaagaggctttccaagcttccaaagccaaggtggaaggagcttttaaggctggagttggtacagtattattctatactgatgaaaaagttatcgaggaccttaaaactaatttcccattgtataaggatgctttcgacatgtttggtgaacacggaatgggaattgccaacatggatgtttggacaacgcttgctaatgaaggcattggggcatcattacaacattacaatccaattgctgacaagttcatcgctgataaatttgatattccggctaactggacccttaaagcccaaatgccatttggttcaattgaacaacctgccggtgacaaagaattcatgaatgacgaagatcgttttcgcgttattaaataattaaaaagtacaaaaaataagctgtggtaaaagttaaaaactttccacagcttatttttattttaagatagcatgccacttttgataaacttcatcgaaacggtactcctgagctttagcgtaagcaccttggcttaattgagcccagagaacatcgtcacttaagattttttgaattcggcgcgccatctgtgcataatccccgttagtaacaatatacccattcttatctttttcaattaaactatgcaatccatacttagtatcaaaagataccactggaacgccgtgcgccatcgcttcaatcaggttcataccggcagcttcactaaccgaagtattgactataacttgcgcacgattataaaatgattgaatttcattatccgtaagataattaccaaagataacctgagcttgaactccacgttgttcaactaaatttttcatttcatttaacagattttggtcgttagtatatcccctaaattccaacgaagcgtcaggaaactgttcgagcaccttaaaaaaggcttttaaggcttccattggtcgtttatcagcttctagtcgaccactaaaaataattcgtcccacaattcggtcccgtaaccaaaccggtttggaattgattaattcgggactaatcgccacatcgggggcgacttgaacgtttaactcaggaaactgctctttaagttccaactgttgttcttgtgtaggaacaataattccatcaaaatcttgagcccggatttggagggcaattgaatatgcagcaaaaggagttccaccttgatccacgtgtgaaccatgcaaagcaacccatttagaggtagcattttctacatcagcaatcacatagtcaagctcacggtgatcggataccactacattatcggtcgtttgttgggtaacttcatttaagaaaaatagaaataactgatcttccgtgtcaaatcgataattctttccatgataattaactaatttccacatcgtaggctgtaattgcccttcaacattcatgtaggtattttcaagaaccacttcgcctgccaaattcaaaaaacgccgtacgcctaaggagccatcggggtgaaagtaatcaattgaagacttaaatccgcgccaatcaaagttttctcgactaacaacggtttcaaagcgatcgtaatattcaatatcacccactaaaccgaccgttccaggcataatattaattcgagctaattggcgaccggcatggtcgaccgttgagtagtcagctccatgttcgaccaattgatattcatttaatgccagttgcttaaattcgcgaactggtaattgaacgcgctctaccgcactagttccctgaaagaaatcatacatattcaaaacattggttgaatttaagttaactcgctcagcatccctaacccataagcgattataatctctagtaacataccgagcctgatcgccactggcgttaaatagcagggtacgattggcttgcgagtgttccactccagaattaaaagtgtaaatactacgactaacaaaatatttcattacttacggacctccccacgatattctggcatcgccttcaacttatctggccaacaattttcagcatcttgcaacaattcttcccacgcgtgccaaacattttcatccgagtaacgctcagctgaatcgtaggctccggttgaatatttctgggctaattgtgggtcttttagcactttaatcatggcttgagcgagggcttcataatctccataaggaaccaccttaccatttacaccatctcctacaatttcatttggtccataattaacatcgtatgaaaatgaaatcaatccatgagcaatgccttccattaccgccaaattaaatccttccattcgagaagttagaccaaacatcattgcgttattttcaactttatcaatatcggtagtgtaacccttcaatttgactacgtcttctaattgattggcttcgataacctcttctactaatcgtcgagcctcgtaattattagaaccatccgcatagccgtaaagatctaaggtaacttcagggactacctggtgaaccaatgcgacggctcggaccaaatcatctagatgtttttcccaagcaatccgcgcaaatgcaacaattttaccaaattggcgttctttaaccgcaactcgtttactgtttaacagttgttctggaacaatcccaactggaatagtgaataaatgtgttttgggttggaaacgagcccgtacatcttgggtctgctttttggtagcgctgataaatgcgtcataacgatccattgatttcaaggcaaactcatagtgttggtttaaagttgaatgcattggattttgagcatcagttgcatgcgaattgtgtaaatgaatcacccgataggcgggtttttccatatttaagagcgcccaatcacctaaatgatcccgatctaaaatatagatattaggttgcgtttctgaccaaaagtcattatttaaatcatcaaaaaaatgttttgtcagctcttcgattgtgtcaaattgataaacttttccagcttgcgttgttaatttccaggctgattgtttcatctcgccttgcgcattttttctggtgaaagcctcaatcgctactcgaccttctggtgttttccattcttcagtcccaatttgattatcgggggtataccactgactaagcgagataaaaccacgactatcataatgatcaactcggtaaagattaccaaatccatcaaagagttcagttgataacacatgatcatctttaatatcaacattgattctggcaactaattgaccatcaatggtttccgctaaataacgctggtgatcaaaatctgaactgaatttcagattttcgactcctaaatctaaatctggaggcgtgacaatcttattttcaacgtgcatcgcctgttggtagtaatcaaacatgctaattacatgttcatcatcgattcctgctaaggcggtaagtcgatgagtttctggactccaatctcgcaaaacaatacgagcctctcggtgcattttattaaagagcttaagacgctttaactgcgcgtgttcaattccggacttcttttctggcatttgtgcattaataaaaaatatcatttttcatttcctcgtgtttccacctgatttttccgttaattattagtccattatagtataatttagcttcttatttgtgaaatcaaggttaagaattaagctaaaaaaaacgaattaaaagtatcatcttttaattcgttttttaatttaaatttatttccgactcattctagtagcaattcgttcaccagtaagagtaactactgaaccaattaaaataataataattccaacaatcgtgttggtatgaattggatcacctaaaacaattagggataggattggagccagcgctggtttgataaagaaaatcaaagaagcaatagggacccccgcttcttccattacaaggaagtataaaccgaatcccaatccggttacaaaaaaacttatgtaggcgactaatagaatattagaccaggtgattccttggaagaatggaacattactgaaaccttgtaatccgctaagggcttgactgacagctggaatgtgagtaattgccatgaaaattcccaactcaatcgcacctgcaataaacgaaaaacacgtcattgtcattccgccaaagcctagcttattcgaacttaatcgagttaagatgccataaatggcgaaggtgattgaacttaaaagtcccagtgtaattcccattgggttagttaaattaaatggattaacaattacaagtaagcccgctaaagttaaaataacggccaacgtattagtccgtgacattttctctttcagtaaaactagtccgattaacatcccaaaggctgggttggcactcaacagaatcgcaatcgtggccggcaaggacatctgaattgctaattgatacaaggtcatactaaccaacacgcacgaaaatccagttaatgaaaaggctgcaatatctcgtcctgtcaagtgacgttgttcccttcttaatcgctgtaatgtaaaaggtagtaacaacaagccgcccaagaggaaacgcacaaaatttaattggatgggattgaaagttcctcccgcaattttaagcgcaatctccattgaactgaataaaaacgtggacatgatcacgtagatcagagttcgtaacttcaatgacaaaacttctttctcttttagaattaactcatctaccatcttaccactttatttttagcattctttgaaacaaaaaaagctgtagccaagaccaccgatatggtttactttgctacaactcatcattattttaccaagaagcttttctaactcctggaatctggccttcatgtgctagtcttctaaagtttagacgcgacattccaaacttccgcatgtaggcgtgtggccttccgtctaggctgtcacgccgatgcatcctagttggagaagcattacgaggaagctgacttagagctcggtaatctttattcgccttaagttcacgacgcaactctgcatatctagctaccatttcttcaattttttgttctttaataatcttagatgtttttgccaattttctacctacccttactttttatcagttaatagattatagctctttacttacttaaagtaaaacaaaaacattcatcataaaactaactgtaatcggtttcattgtgataaaatcaattataagaagacataggagggattgtattttgaagattaataaagaagagttccaaaacgtaaattggtacacgctttctaatgacaaccatgtttctgttaccatcagtaccctaggggctacggtagttgctgtaaatacccctgataaaaaagggaatgtcgaaaatattgtcttaggctttgataatccccaaacttatccaaagcacaacgattattttggtgcttcagttgcgcgggttgccggccggattaaagatggtaagtggcgcgattaccaattaaatcaaaatgaaggtcaaaatactttacacggaggtaataagccttcacttagctacgttaattggaagaaaatcagtaaatttatccgcccagaagaagtcggtttagttcttaaacgttttagtattgacggtgaaaatggctttcctggcgatttaaccatcgatgctattttccgtttaaataaccgaaatgaattttcgataacttatatcggtcacgcttctaaacaaaccctcttcaaccccactaatcatatgtactttaatcttagcggggatgctaagcgttcaattaagcaacatcaaattgaattaaaaagcgatgtaatcgcagaagttgatgcagagttaattcccactggtaatttattaaacgtggatggcacaccgtatgacttgcaccatccaacttcaatgcaatccatgcttgatcaagtatcagacggattagacactgctttcaaagttgaacctagcatcgaagcacctcaacttacgctggaagatcctgaatctggtcgtaagatacgggttcaaacttctgccaatgcctttaccctctttactactaatgagccacaagagccattcaaaattaatggcaatcaagatatggcagccaacatcggattagcaatcgaacctcaaatgcttcccgatgccatccaccattccggcttcggtaatatcattatttctccatctaaaccgatgatgtatcggaacgtttactatttaaactaacaattttttgaaaaaggttctgtaatcagcttatagtttgattgcaggacctttttatgataatttaggtgagttattaatgcacctcaacacaattatgactaaatcaataacattgggggctctgctatgtttataattggtatttcgataattatttttttgatttccggaacttatttatatttagatcgtcgagattttattgcggggattgtttttgccggtagttgcattaacttagctttattatccactttgtggattgctaattatctggcaggaggttcaaggactggaattgttagccttacggtcttcctacttttaggaattgttttgacgccgttagtaatcggcttcagtttgattgttaacacctacattatgcaaactcgtgaaggcaaaagtttaactgccaaattatcgcttattttaggccttaattttttattcatgttggttgctggtttagctattttgtttttgaatcaatttttaggacgcttcgttggaattttgcttacccttttagggattgatgtaactttaactttcatttttgtttgttatctcttttattcatttctttatcaagtggttcctatcaaaggcaacgtggattatattattgttttaggagcgggggtacgatctgaaaccgtaactccactcttaaaaggacgcttggataaagccctcgaatattatcgaagacaaaatggcgctgtgaaaattgtggtaagtggcggacaaggacctgatgaacccgtctcagaagcttttgccatggctaagtacttgagaaaccaatccgtacccgaagacaaaattattttagaagaccaatctactactactttcgaaaatatgcagttttccaagcagaaaattgaagccgattggcagggaacccaaccgcctcaaattatttttgctactaataattaccacgtcttacgtggcgtaatctatgcgcgtaaagctggcttaaatgctaacggtgtaggatcaccaacctcattctactttttacctagtgctttaatccgtgaatacattgcactattagttatctataaaaaattaactgctttaattttactaggttggatagccttgggaattttattaatgctctaaaaactaggaggtttacttatgcgaaaaggaatgattatcagtggcgtggtcgtcgtaattcttttaattacttttggaagcgcctatttctggtataactctaactatggtactcaggattactacactcaaatcgtcgataaaggcactaaatttgtggaaaaagatgattccaatcgtagttatgtgaattatgcttaccaccaacctgcttataaccaagctggtcaaaagataacggttaaatttaacggaaacctagaacgtccattaaagctccacgcatatttgaaaattggctacaatgcgaaacgaaatcaagttatttcttggagtaaagttgataaaaaagacgtccccaaggcagccttgaaacaaattaatccttaatttcttcaaagcactttaacgttagcttttttcaaaaatgtgccttaaaatatgggtagaggtgatggataatgacacgaaaaattggaatcattggtatgggtcacgttggtcaagcagtcgctcaacaaattatcacaaacggctacgctgacgacctagttttaatagataaaaatgaagcaaaggttggtgctgatgcacttgattttgaagatgcaatgcccaatttaaccagtcacacaaacattatcgtaaatgattatcgtgccctcaaagatgcagacgtaattatttctgctttgggtaagattgctttaactgataaccctgataatgaccgttttgctgaacttccgcacaaccgtgaacaagttcaggcggtcgctgaagccattaaggcatctggatttaatggtattttaattccaattactaatccagtagatgtaattaccgcactttaccaagaagccaccggcttacctaaagcacatgttattggaactggtactctacttgattcagcccgcatgaagcgcgccgccggcaaaggtttaggcgttgaccctcgctcggtatctggatataacctcggcgaacatggtaattcacaatttaccgcttggtccacggttaccgttcttgaccaaccaatcaaaaagttagctcaagctcggaatttagacttagatcaaatcaacgaagacgctcggatgggcggtcgctatgtaatggttggtaaacactatactaactatggggttgctgccgctgccgttcgtttggctaatgtagttttaaatgatgctcatgaagttcttcccgtttccaattatcgtgaagaatatggtacctatctttcatatccggccgtgatcggacgtgacggtattttagaacagctccaactcgaacttaccgatgaagaacgctacaagttacgtcgttcagccgacttcatcaccgaaaaaatcaaagaatctaagtaaaaaataaaaaacttcaatctttgcttaatcgcgattgaagttttttattttcgtcttactttttgtacttattttcacatgaagcaaagatgcctaatcgaatgtcaaatccgaggcagcttacgttcatttcgtcagctttttattgaatttttaagaatgcatcggcaatattaaagcttggatcgcatttcacttccacttgatctcctaaatcgtggatttgaaatttaatccattggtcccccactaaggcctcgccattgcgagcttgtagcactgacaatactaaatcatcaccgccttttaaaataccgcgtaccgtattatcgccacgcatcacgttagtaactcctaacactagatcaggtgtttctacttcactatgtccaagtctaactttataaatcggcactactacactcataataagcatcctcccatcaacctaaaaattacttgcattaattacctcgaattatatcggcttgagtaagctttagcaaacattctgctcaacttataatatatatattgcttattactttacttttttgtttacacgcttatataatgtgaccacaaactaagaaaaggggtgcaataatttgaaaaatattaatgttttattagctgccgacgaaaattatgccgaccaactacagatcaccataaaaacaacacttgaaaacctaaacaaaaaaacacgtgttaattttattgtgctatctaacaaccttagtaattctactaagctagctttaaaaaaacttgcacatggattgcacacggttgagtgccttgatttggatccatcggtctttgctttttgtcctaccaacagccatattaacaaaactgcatattaccgaattttggctccccaattactagcaaaacgtaatatcgatcgaattctttacttagatgttgatctattggttcgccacgatttaaccgagttgtacgacgcggaattgaaccataacattgtgggtgcggtgatcgataccggccaagcttttgctcttaatcgtctaggagtcgacccagtagttgctgcaaataatatctatttcaactctggaattttagtgattgatattaaaaagtggaatgaaaaccatattaccgagaaaactttaaattacattaaacatcaatcacatctcattattttccatgatcaggacgccttaaatgccgttctggctggtcatgttcaaatgctacatcctaaatggaacttacaaaattcgattgttttcagaaaacaccgtccaattaacgaagcctacgatcaattgatcaacgaagccatcaaaaatccggcaatcgtccattttacaacacatgaaaaaccttggaaaacgcttagtgaacatccttatttggatgaataccacgaagaacttaacgaattagaaatcaatcgtggcgtggttaatgttatttctgccgctaattcagcttttgtggaagctttggcaacttcttatatttcaattttggagaatgactcggaaaatcaatacaacttctaccttctcccagatcatctagatcaacgtgatatgttaattttaggaagtgtaatttcacgttacgacaacgcttcaattaaaatcgttaaagttgatgaaaaactactagaaaatgcggttgaaagtgatcgcatcctaaaatctgcctattatcgaatcttagcaccagaattgttgccaaatattaatcgtgccatttaccttgattgcgatattatcgctaacaccaatctacatgatttatggcaaacctcactggaaggtaatgttctagccgccgtagaagatgctggtttccatgatcgattagaacacatgggtatcacgcatgataatagtaaatatttcaactctggcatgatgctaattgacctagttagctggcgttcccaagcagttactcaacgcgtcttagactatattaaccatcatccagaaaaactacgtttccatgatcaagatgcgctaaacgcgattttatacgacaagtggttacacttacatccaaaatggaatgcccaatctaacattgtgttagacgcacttgttccaccacggactgaacttttgaaactttacgctgaaacacgtgaaaatccaaaattaattcatttctgtggtcacgtcaaaccttggcatgcagaaagtaaacacccttatactaatgtctacttgaagtacaacaagaaactacgtgaaccagtacggacttaatttttcataaataaaaggattgatatggaatcatctccataccaatccttttatgtcgttcaattaccatttcaaccttttacttacttcttatctttcttttctttcattagccgctgattagctcgttccccatctttaattttttgccgatactttcgtcttcctaaatacgccttaatcacaaatggaatctggacaattacataaattataaaaatgatgagtacaattcgatacatttcatccctccgtcaaaatgatttggctgtactatactacaaaatccagtaaaaatcctttagttaaccttctttgtatagaattcccactttttttaactgttccttagctttttcgatattttccattttatccgctgccaaagtatggctatggatgccatcggttaattcagatagcaagtgtcctttggcttcccgtacatgttgcataaactgtttgacatcattgctattttgcacacggatttgtcccactagttgtccgtaaagtgggtggtcaaccataacgtctttgatcgtcacctgttctttaacaattagttccatttctcgctctgcttgatcggggaaatgacgacaaacgatcatttcttcaaatcgatgatttttggcatattcatagcctctcgaagttgaaataatcggctccccttgcgcacgcaacaaagctatatccccaacaatagtttgtcggctaacctcaaattgtttagccaatgtgcctgctttgattggtgttttagtttctaatagttgatttttgatagctatttttcgattaattttcataagtcattactccttgagtatattttatcagaaaatccccgttacaagtgtcaagacattaattttaaataaatcattgataaatattgttttatgttgtaatcttgtattcaactcagagtgtgtcttgacaccaaaaaggagaatgatgattttgaatggaatttcaaactataaaaaattactagcagcttcgggggtagcctggctttttgatgccatggacgttggtatattatcttttgtaattgctgctttaacgtcagagtggcatttaactgaatcacaggttggtatgattggtagtatcagttcacttgggatggctgtaggcgctattttatttggagcgctggccgaccgttacaatcgaaaaacaattttaattattagtttactaattttctcaatttttaacggtatttcagctttcaccactacctatgcggcttttgttatgattcgttttattgtcggttgtggattgggtggtgaactacctgttgcttcgactttaatctcggagagcgcccctgctcatgttcgagggcgggcagtagtgctcctcgaaagtttttgggctggcggttggttaatttcggctttaatctcttattttgtcattcccagttggggctggcggattgccgtgtttatcacttccttagcggcgctctatgccttggttctccgttttagtattcgcgaagcagattcaaatcattcttttacacccaaagctcgcctagccttacgtttaaaaaatatttggagtcgtccctatgctaaagccacgttgatgctttggattgtttggtttatggttgtattctcgtattatgggatgtttctttggctgcctagcgtcatggtgatgaaggggtatagtattgttcacagttttggttatgtgttaatcatgactgtggcacaacttccgggttactttatggcagcttggttaattgagcgatgggggcgcaaatggactttgatggttttcttattcggtactgccgtcagtgccatcgtctttggttttgctcaagggctgatgatgttattgttagctggtattttactatccttctttaatcttggtgcttggggcgcactctatgcctattctccggagcaatatcctgaagaaattcgtggaacaggttccgggctagcagccggaattgggcgcatcggtggaatcgtaggccctcttttagtgggatttttaactgaaaaaggcgttgctttatcaactacttttataattttcttcatttccattatgatagctgtaattgcaatcggcttcctaggtaaagaaactatggaaaaataatttttatgggaaaatttttacgctattactagctttgatgctcttctagtatcacttctatagcaccttaattagggaggtatttgccacaactccatcaaaagcgctaaaatagtgtctataaaattagaagagagaaggtattccattggaaaaagcagctttaatactagaaggcggcgctctcagatcattttttactagtgccgttttggattattttctcgaaaagcaaatggatttcgagtacatccatggagtttcagctggaaccatggccgctatgaattacatttcaaagcaaaaaagacgttccgctgatgttaatctccattttcttcatgataaacgttatattggttttaacaacctcattcgtaatggtggaatctttaacttagattttttgttttcacctgaatgttatgattacagcccctttgactataaagcttataatgaaagtaaacagatttttgaaattaccgctaccaacgtcttaactggtaaagccgatattttccgtaaaacggataccgatggtcaagaagaagccgtcaaagcttcagccagtatgccattagtatctgatatccgggtcgttaatcaccagccatacttagatggcggaatcgctgactcgattcctttcagacgagctcaggaattaggctacgaaaagatcgtcgtggtcttaactcgcgacattagctaccgtaaaccggaaaatagccgcgctatgaatcgtttagttaagtttagataccgtgattttccacgttttgtccaagcttttgcagatcgtccacaacaatataatcgttcattagcagaaatcgaacgcttagaacgtgaaggaaaaatctttgtaatacgtccccaagaacccgtttcagtatctcgggttgaacgtgatgataaaaagctcatggccctttacgaaaaaggaactgaagttattcaaaatcaatttgcagatttacagaaatatttagcacaataagtaaaaccctccgaaaaattaattttcagagggttttactttatttttcaacgattacttgttccatcacaacatctacgttagggcgatcttcgccattacgttttaccttactaattgctttaacaacatccatcccttcgaacacttgtccgaagaccgtatgccgaccatctagccagggagttcctccttgacgatatgcttccacaatttcttcaggaaattctgccgctttaagttgtttaatcattcgcttaggaacattactgttagtaacgataaagaattgactaccattagtatttggaccggcgttagccatagatagggccccgtttaagttatagagcttatttgaaaattcaccttcaaacgttctgccatagatgctttcgccacccataccagttcccgtaggatcaccaccttgaatcataaaatctgggatcacccgatgaaaaataacgccgttgtagtagcccttctctgctaattcaataaagtttttaactgttttaggtaccaattcatcaaaaagttgaattttgatgtcaccttggttagttttaatagttacttttgtaccagttgtattttctaagtctaattgtggataagccatttattaattctcctgcttcttttttttggtcataaaccattctaatctatttgaaatataaaaacacgtctaaagtaacggattataaataaaggatttttaccacataccaatcactttcattcaaagcgatccaaccccaattacaatgtaaaccaaaaccacacccagaatggcattcatccgccaccaatctttttgctttataaagcccgaaccaaatagaacggagacaggctctaaagtcatctattttactcctctatttatcataattagtcatctcaatgggaaccacccactgatcaaattgctcagcggtaactttaccagattttagggcagcttctttcagcgtggtcccatctttttcagcctgctgagcgattttagcgctatcgtggtagccaatatgaggagataaggcggtaactgtcatcagggaatggttaactaattcttccatccgttctgcattaacttctaatccagcgatcatcaagtcggtaaaactacaaatcgtaccttctaatagagtggttgattccaagaaagagctgatgataactggtttataaacattcatttcaaaattaccttggcttgcagctaaatcaatcgcaacgtcattagccataacccgcactgccgccatggtaagggcctctgcttgagttggattgactttacctggcatgattgatgatccgggctcgtttgctggtagtttcaactcgccatatcctgcccgcggaccactacccaagaaacgaatatcattagcaattttcatcaaatcactcgccaaagttttaatcgctccgtgaaccacattcaaaccggagtgatgcgctagtccataaaatttgttagaatctgccgtgaattcaaagtggtagacttcgctcatctgagctgcaattatggacgaaaaatgcggagctgcatttaaacccgttccgaccgctgtaccccccattgccaattcacttagcgttgaattaagttcttttaagtattccaaatcatgttcaagggcgctcttccatccactaatttcttggccaaaagttagtggagtcgcatcctggaggtgagttcgtccaattttaaccacgttccaatattgcttttgtttttggtctaattgctcaattaaatgttgaactgcctcttccaaacgtactaccgctactgcagctgtaatattcatggccgttgggaaaatatcgtttgaactttgtccatggttaacatcatcattaggcaaaatttctatttccgcattaattttagcagccatatgggccaccacttcgtttacattcatgttagtttgcgttcccgaaccggtttgataaactaccagcggaaaatctttccgtaattcagcatcatccagtgctagcagacgatcaatagctactacaattaaatccgctttttcagcagccattgattgttcctttttattagcgatggctgccgcttttttaatctgtagaagagctttgataatttccaggggcatcttggcaccagtcgcaaagttatgacgacttctttcagtttgggctccccaaagtgcgtctactgggatttggacgggcccaagggtatcttcttctgtacgatatttttccatattatgacctccgaaattaattgtctaagtcgcattcctactaatttgcttcgtttttattataaaggactcccgataaagcaccagtgaaatttaaaataaaaatacgacccacctaggattatccatcttaggtgaatcgtatttaataactaataattcttacaggtttaaacgagcttaaaatcttactaattaatggctgagataaagcgcgcaaatgcagcttcaccggcgtcatcccatttaaagactcctgcatcagctaaaactcgcgcaaaaacatttccaaccgcagtatttaccacggcagtaacattttctgcggtaattgaatgtgttgccttcaattgatccgcccaagcttgatgcatttctgccatttggttagtttgacccaataggtacttttctacttctaccaattctgtctttaaccgagctggtaaaatcgctcttcccattacttcaatcaaaccaatgttttcttttttgatgtgttgaacatcttgatggggatggaaaataccatctggaaattcggctgaggtttgattatctcggagtactacatccaaaacatagttttctccatccttgtacgcaatcggcgtcgtcgtatgatgacgagttccgtccgtgaacgctcttacatcaacactttcatcagaatagttcatccacgcatcatgaattttaacagcagcatctgtcaatgccaccacatcactaccaactaaccgaattgttgacattggccatttcacaattccagcttccacacctgctactcctaaattaatcgttctagcaatgggagccttcatcattggaaatacatgacgtccgccttggtaatgttcgtgtgataacatcgaacctcctacaatgggtaagtcagcgttactccctacaaagtagtgaggtaactgtttaacaatttcaagtaaattggtaaacgtctgacgattaatcaccatggggcggtgaatttggtctaagaaaatagaatgttcattgaaatatgcgtatggtgaatattggaagccccaagtttcaccacccaaggtcatccgaataattcgatggttgctacgtgatgggtaacccaaacgtcctaaataaccttcattttgcatgcataattggcataatggataaccatcctgaggttgattacgagcagctgcaattgctttaggatctttttctggtttagaaaggttaatggtaatttcaagttcaccaaaatcagttttcgctgggaaagatacattcttagcaatggcccgtgttttaatatagtcattagttttacttaaattaaagaaataatccgtcgctgctttagggctaacttgatacttatcccaaaaacgttgatttaaaatcgaaggtaatggcgtaactaaatccattaattgatctgccaaaatgcttcggtctgattgagcatcttcaattttaccgttttgaaccgcagttttaactaaggcatctactaagctagtcacttgttcatcggtagcttcaaccggttgatcttcacccactaaacctaaaatccgattatgcacataaattcggtctaaattggtgtatggtgatggcgaatcgattacaacttggacaaattgttctaagctactcattaggcttgtcctcctcggtcatcgtatccagctggatggttgactttccaattccaagcagttttgataatttccttaacatcatcatattgaggttgccaacctaaaatttcacgtgctttatcactcgctgcgattaaagtactagggtcgccagctcgtcttggtgccataacagctggaatttcctttcctgtcacttcccgagcagcttctaacatttggcgattggagaagcctgttgaagatccgagattgaatgcgttactatcatgaccttgtttgagatattctagagctaaaatatgagcatcagccaaatcaacgacgtggacgtaatcgcgtacattagtaccatcaacagtaggatagtcatccccaaaaatttgcaactgatcccgttcaccagcagccacttgtaagataataggtactaagtgtgtttctggttgatggtcttccccaatactgccatctggtttagcaccagcaacgttaaagtagcgtaaagccacaaacttaatgccatcagccacatctgaccaatgcatgattttttccattgctaacttactttcaccatatggattagttggaacttgtggatcagattcttgaattggtacccgttctggttcgccataagtagccgctgtagatgaaaatacaatccgtttcacatcatgtttagccattacttcaagaagtttaaccatcccagcagtattattatcaaaatacttcaaaggatctttcattgattcaggaaccacggaaaacgcagcaaaatgaattaccccttctacgttttctttggtgaagactgaatccataaattcaacatctcgtacatcgccttcgtaaaaacgagcttgctggtttacggccgcgcggtgtccagtaaccaagttatcaacaaccgctacatcgtaacctttcgtaattaatcgatcaactgcatgggagccgatataaccggcaccacctaaaactaagaccgccattctaattcctcctcaatctctcaatacgtattactatttaaaaattttcactaatattaaagttctttaggtccatcagcaatttcagcaatatagaaatcagcatcataaccaattgtatcgcgataaactttaccaacattttccttgaaagcttcaacttggtctttttcaacaattgcgataccacaaccaccaaaaccagcaccagtcattcgagcacctaatacaccaggttgtttccaagctgtttcagctaaagtgtctaattccttacccgttacttcataatcaaagtgtaatgaaacgtgtgaagcagtaactaattcaccaaaagttgttaagtcgtcatctgccaaagccttagttgccttgatggttctttgattttcaaaaacagcgtgacgtgcgcgtttaattaaagtttcatcattaattaagtaagctgcttcatcaaattcatcattagttaaatcacctaaagtcttgatgtctaacttagtttgtaaacgacgcaatgcttcttcacattcagaacgacgttcattatatttagaatctgcgagttcacgacgtttattagtattcataattacaatgacgtgattgcctaatttaaccggagcataagaataatcaagtgtgttagtatccagcaagattgcttgatctttcttacccattccgaccgcgaattggtccatgataccagagttaacaccgacatagttgttttcacacttctggccaatcttaactagatctaattgactaacgcctaaatcaaaggccgcgtttaaaactgctccggttaataattcaattgaagctgaagaagataagcccgcaccatctggcatatttccgtgaacgtagagatcgaagccatggtcaaacttaactcctgttttgactaattcattcatcattcctttaggataattagtccaacctgcagccttatcgtaatccaaagcattgacatcaaaactaacaactccagcatctggaatattagctgagtacattcttaccgtattatcggtacgaggagcataaactccgtaagttccgattgtaattgcacatgggaatacgtgaccaccattgtaatctgtatgttcaccaattaaattgattcgtccaggtgaaaagaaaaccctttcaggattggtgtcaaaaatttcggaaaattctctttttaagtcgtttgcgttcatgatgtgtctcctccataattttactaaaattttattaacttgaatatatagcttttaccatcacttgtcaatacctctttaatccatttacaacaaaaatggtagcgcttcattaaaaaacgatagtgttatggatttagggttacttacagcttactaaatcctccaaaaacattaattttggttaaattttaactaaaacaacgtatacaaatttagggttatgttctatcatttcattgtaagcgttttatattttggttacgaaaggagttctattatgcaagcaaatcttcagtggcttgatgatcctgaagtttttcgagtcaatcaactacctgcccatagcgaccaccattactatcgtgatttagacgaaatccgtacaggtagtagtagctttattaaaagtctcaacggcccttggcgttttcactttgcgtccaccccgtctgaacgtccactccatttttattcacctgattttgatagtgctgattttgatacgatacaagtaccagggcatatcgaattagcaggctacagtcaaattcaatatatcaacactctctacccttgggaaggaaaaatttatcgtcgtcccccttacacacttaatcaagaccaattaaaagttggattatttagcgatgctgctgataacagtgtcggctcttatttaaaacaatttgaccttgatgattcatttaaaaatcagcgagttatcattcaatttcaaggagttgaagaagcattatacgtttggttgaatggccattttattggttatgctgaagatagcttcactccttcagaatttgatctaaccccctatcttcaagaccaagataatcttttagctgtacaggtttataaaagaagtacggcagcccttattgaagatcaagatatgtaccgcttttctggtatttttcgtgatgttaatctcctcgctcttccggccgcccatgttgtggatttagacatcaaaccggaggtaaaagatgattttgagcgcggtaccttggcagttactgctgacgtttctggtactgatgctatcttagaactaaccgttacgaatcaaaataaacaggtagtggccagtcagacccaaagcggaatgggtaaggtcctgtttgattccatgccgtttgataatttgaaactatggtcaccaacaagccccaccttgcatcagttgttgattaaagtctacaacaatcagcatcaactcttggaggtcgttccttatcaatttggttttcgacgagtggaattacgtgaggataaagtcatttatgttaataaccaacatttgattctcaatggggttaatcgccacgagtggaatgcacatagtgggcgcgtcattaccatgcaagatatgcagaacgatattcaaaccatgcttgataataatatcaacgctgttcgaacttgccattatcctgatcaactaccgtggtacgtactatgcgatcaagccggtctttacgtcatggccgaaaataacctagaatctcatggttcgtggcaaaaaatgggagctgttgaaccttcctataacgttcctggggataatcctcattggttagcggcagtcgttgatcgggctcgttccaactatgaatggttcaaaaaccacccatccattattttctggtcattaggcaacgaatcctttgctggtgaagatattgcggctatgcaaactttctataaagaacatgacgcatctcgactggttcattatgaaggtgtcgttcgtgctccagaattacgcgatcgtatttctgatgtagaaagccgtatgtacgaaactccagctaacatcgctagctatctagaaaataatcccgataaacctttcttaaactgtgaatatatgcatgatatgggaaactctttagggagtatgcaatcgtataatgatttaattgataaatacccaatgtatcaaggtggcttcatttgggacttcattgatcaagctctgttagttcatgatccaatcacccagcaagacgtcctacgatacggtggtgatttcgatgaacgccattccgactatgagttttctggtgatggattactatttgctgatcgaacccctaaaccagcaatgcaggaggtgaaatactattatggattacacaaataatcaattacacgtcatatatggcgatgccagtttaggattagaaggtcctaactttcactatctttttagttacgaacgaggcgggcttgaatctttagtggttaaccaaaaagagtggctctaccgcacaccaactccgctattttggcgagcaactactgataatgatcatggaaatggttttgatgttaaagctgcacaatggtacgcagccgatcgattcacaacttgccaaaagattgacctaacagtggatgggcaactcgttcaaccgcttcctattgctccccttaataatcgctataccaaccatgaaatggcaaatcaagtggcgttaacctaccatttcgttactcccacggtgccaagcacttcggtaagcattacctatgcggttgctagtgatggtaatattaagatcatgacccattttgcaggacgtgaaggtttacctgagctatcagcatttggactacgtttcattatgcccacgaccgctaccggttttgactaccaaggactttctggggaaacttatcccgatcgtctagcaggggcaactcaaggtcaattccacgttgacggattaccagtgaccccctatcttgttcctcaagaatgtggcatgcgcatgcaaaccagtcaactaacggtaactcgttcgactactcaaaataacgccgatcaaagcaagcaaccttttagccttactttcagccaggcagatcagccgtttgctttcagttgtttaccatatactgctgcagagcttgaacaagccactcatcttgaagaactaccattaccaagacgaaccgtgctttcgatctacggggcggttcgcggtgtcggtggaatcgatagttggggagcagatgttgaagcaaaataccacatccctgctaaccaagatttagatttcagttttaatattcatttctaaaataaagccgatgctggaaagatttaaattctccaacatcggcttttaatatgcaaaaaaagaacaatcaatgaataaatcattgattgtccttttaaaatccaactttaattagataatcccgtattggataacttcaatacatcttcgctatccttaacgtcttcacccagctctttgagataatcaaattcaggcatatccttgttggtaatgactaccattacagtatcatcaaggcctgcttttttaattgctggctgccagaattcaattaatttttgtccttgtttaacgtgatcgcctttttcaacatattgaacaaatcccgtaccacgcatttcaacggtaccaattccgatatgaatcaaggttaagacgcctgtgtcagaacgaagtccaatcgcatggcgagttgggaaagttgctacaacttcaccatcaaatggagctaaaacttgaccatcggtaggtttaattgcaaatcctttacccatgcttccactcgcaaatgtctcatctgcaacggtgtctaaactgattaattttcctgaaaccggattacggtaaagagttgtaattccgtcttctttttcaatttctgcaggtgtttcatctgtttccaaatgtgttgaccaagttttttccagctcgtcaacgatttcagcatgcattttttcgtctaatttaaccttcttgaagaagatgaaggctccaattaaaatcatagctgctggaacaccaaacatcatcaacttgaaaatagcttgtccgtgggaagttacgtccccagcagttgctccagcggtcatgccagcccaaacggcagttaaaccaactacaccgtttgaaatagctccacctaatttatcaagcaaaggacgaacagatagagttaatgattcgtcacggtgaccaaatttcaattgtccatattcaacagaatcacttaaaaccatcaaaacaactaagaagataagtggttgtggaatgtagaatagtacggcagaagttaagatcattggtaatgactgcccggcaagtgcaaacataatcaaagcaatgatcatgactgaaatagctaagaagaatactttacgacggctaaacttctttgccaatggtgggaaggccaatacggcgaacaccccaatgatagcgtttaatgaaccaagtaacgtaaatttcgaagcatcacctaaaatgtaagtgaagtagtaaagttcaagtgagttagtaattgccataccggccgtgtaaattccgtaagtcaaagataaccacattaattggtcattacgagccaatactttgaaaacttgtttgaaagttgttttttcagtatttttacgtaattcagaatcattttctttagttcccactgctacagctaaagctgaaatcaaagcaaccgcagcgataataatcccgaaggccatccaaccacgattatcaccttgtccgctgttcgccttggttgaaaacatcaaaacgattggcataacgactacaccaacgatattttgtccaatgttagaaccaacccgggcataggtagctgttttttcacgttctgctgaatcaaatgaaatcgcaggaatcattgaccagaacccaacatctttaaatgaatagaaaatatccattgtaatatataaaatagcaaaaacaattaagtataaaattgggttagatgtatttaaaccacctaaactggtaaataaaagtgctaaaacaactgaaccaatcgttccaccagtaacaatccaaggcttgaaatgaccccagcgtgaattggtattatcaatcgcgttaccaattagtggatcaattgcaagttctacgaaacgtaacgctgcaatgatcatcgtaatgtacgcgatcattttagttccttgagccccactactcttatcaaataaatgggaagtcacgaacataataaaataggtcgataatgttgcataaaacgcatcatgaccaaatgcaccaaatgagtaagctagtcgcgaagtgattttacgacttttgctttgtttaacttctgcatccataatctataccacatctcctttaattatctatgcactaaatgtaatcgttttcagagaggatgtcaatgttttttagtaaaatttgcttaattattttagtaaattagtatttaaacgacctagtccgcttctcagaccaatttatcgttgcccatagccaactattccaatcttttttcgattttaattttggtgttttaggccactcgatgtagttttactacctactttttaaattatttaaccattaaaaaagcgctcggtttttacaccttacgcttaatttagatttagtttaaacgttcatattgataacgaatagtatttgtaactggcttacctggacgtaaaacaatatcaccaaaatcagaatgattgattgcatcaggtaatgtttgtgcctcagtagctaaagcattgtactcatgagctgcttcttggtcgggatcaaatgggttcgccgtgaatacaactagtccgttgcgatctgaataaagctttactcgacgtttaccatcagtatcacctaccattgcaataggagtagtttcactcggattaacttcgtaagcatcatcaaattcaatcccaccattttcagcgtttaactgtttcaaggcgtcctcaataggttgttcttgattaaaatcataggcggttgctttaactgaaagcttcttaccagtggggactttttcttcatcaaattcaaggtgagccgcactgttaatttgcaaccattgtttagccaaacttgttcgatcatccgttgtattccaataaacatgattcgttgggttaaagagcgtcgcagcgtccgtatcacccgtaaatgaaatcgaaacttgattttgattgtctagggtaaatttaatttctacatcgagatttccggggtaattatcatcactcgccttaatatgtttcgataaaatcacgctaacttgatcatcatcttcactaaatttaccatcgaagtttaaggtattaaaaccgtggtcaccaccgtgcaatgaatgagtttgttcgttcatctcaacttggtattcttgatcatcaatcttaaatttagctccaccgattcgtccagcaactcgcccaattgattgacaaaggcaatagcctacgcggtgataatcagccatgctatcaagtccccaaattaatgagtgttccaccccatcctcattaactacgaattcttgccatgttcctccatagcttaaaactgaaattctagtttgttggtcattaaccaatgtataacgtatgacatcctgaccatctatttgatcaaatacttcttttttagtttccaatattatgacacctccgcattaattaaaccgctttcatttttagtataccaaatttggctgaggttgagtaaatattttagttaaaataaaaagactcatagtggttggataatttaatccgaccactatgagtctttcacttctattctatttcgtactagctcgttctaccaaccttgtacccagttccacacgttgcgtggtggtgcgaccggtcaaacgactcattactaaattgactgctgtggcacccatcaactccgtatcaacgttgactgcacttaattcaggataaacaaaagtagctaatgaagtattgttaaaactgaatagcttaactctgtctggtactttaatgccatttgtctggagtgctttcaacgccccagctgccatgggatcattggccacaaaaaacgctttaggtaactgatctccgagcacatcaattgccttttgcatcattttagaaccagattcgctagtataatcaccctcgaatacaaattccggtttaaaggcgttacgcttggtcattgcggccttaaatcctaacattcgacgatctgtaacagttaattggtgatctgtcgtcatttctaacccatggataatcccaatatcttcaatcccctgttgccagaaataatcgactactttttcggtggctaattgaaaatcagttatcacactgtcaaagccagcttcaaattgatcatcgtccacaaaaactaaattatcagtaacggctgcaatttcttcaacttgcggtttactaaattttcctactgctattactgcatcaacatttgggcctagttcttgtaaattattctgaaaaattcgtgtcacttcgaattgattgtcttgtccacgttgctcaattcccattcgaatcgacatataatacaagtcatcttgttcttcagtttctgagtaccattgaacaattgccaagcgttttctagttgttaaattattatgtcgtttatttttggaatagtgtagggcttcggcggtttttaaaattttttgtctagtttcatcgccaactgaaagagacgcatctttattcagcacgcgtgatacggtcgctaacgatacgccaactttatccgcaatatcttttaatgtggctgccatgagctgcctcctttaagttacttaattgtgcataaattcatttttctattaatgtacctcgactggcacacaatcgtgatagcactcatgtaaaactttatcattaaatattggaattggcgactacaaaagtccctacttttaataaaaatagttaaaattatcattttatttggtttaaaatacatattatttagctactcaacaaaggcttgggaacctaacaaataacttatcaattagactaaaaagaagattaaccttaagtaagaattaaccttctttaatcatcgacactaactcctttaccacttttgaaaacgctaacataaacactgtcagtttaatatagtttttgtgtcggatcaatgcttgaattattttaaatgattggtagattgtaaaattaatccgaacgctgttcggacaaaaaagatcagcttcctttaaaatggtgtttaccacaaacccatcttttaggagctgatcttttgtctagtataatctattccgaacgaattaaaatcgaaaccttttgtgaactagggctgtccaatatccaaatgggcgtttggtattgttaatgctttaaatacgacaaggaggaattttatggcaaaagaaatcggcattatcgttggtagtttgcgtgaaggttcattaaatcgacttgtggcaaaaacatttgaaagtatcttacctaaagaatatgaggcaacgtggattgagattggtgatttgccattgtataacgaagatttagatcagggtgaaatcccagcagaatggcaaagactacgtgatactgtgcaaaatgtagcaggggtaatgttctttactcctgaatataatcgttcggtaccagcggctttaaagaacgcaattgatgttggttctagacccatgggcgaaaacgtttggggtggcaaaccagctttggttgtatcggcttcccctggagcaattggtgggtttggggcaaaccatcaccttcgccagtccttggtatttgttgatatgccaacccttcaacaaccggaagcttatattggtagtgttccgcaacatctggatggtgaccattttgatcaatcgactacgcaattctttagtaccattcttgattcatatttagattttttagagcgttttactaactaacttaaactaaattatgcaaataaaaatagcctaaccagacggaaattccgtgggttaggctatttttcattgtgctttttcccctttagcacgtgatcagcatgttcaagagtttcattaacaatatctaagatatgcggatcatcgagttcataaaaaatcgatttaccatcacgtttagttgaaactaactggtatttacgcaaatctgatagatggtgagagaccaacgactgatcgagatggagaagttctacaatttcagaaacactgaggctctgctgcgacagaatgtataaaatttgaagtcgcaccgggtttttaagcaagctaagaattttttgggtctcagtgagcatcacatcgtcaattaattttagttttttttgcttcatattaacttcctttcatatgaatatgttatcatatgtatgtaaaataaggttggggaggaaaagcgatgataaaagatattttaacaggtgtaactgcatatatatcaactagtatagactatttaatcgttttgatggtcgtatttgcgatggttcctaaaaataagcgtattttagtttactttggtgatattgttggtacaaccgttttagtttcagcaagtttaatgattgcattggttttaaagtccgtccccgacgaatggatactaggattgctgggattaataccaattgctatgggtatcaagttgatagttgcgggcgctgctgacgatgaagatgtgattcaaaagcaaatcaacaatcggcgcggcgtaatcttgaatgttgcttttattacgattgcgacttgtggagcggataatatcggaatatatgtcccaatatttacgcagttgagcgtagctagtttaatagttgttttactaacgtttgtagttatgatgaccttgtttgcgctattaggatatctattagtttgcctcccaacagtggcaaagatttttgatcgatggggaactttagtaaccattattgtttacattggattgggaatctatatcctctttgagagtggaacaattcaacattttattaatctgatataaagttaagcacagtctatgaactgtgctttttttaacactttaacgtaaaaatcattgagtattaggaagtaaaagcttactataaatggtataaatagtaattaaaaagtcttttggaggagtttttatgaataaaaaaagaatcactggtgcagctttagcaagtgcgcttttatttgcgcccttagctatccaaacttctacagcaatggccgatagtttttatacacaacaaaccaatgctgaacgtgccgatatcactaactgggtagctaacacaactgaagacattagtaataatattaatgctcaacatattgatactaacaatttgcatggaaataaatacgtaattcaatggggagacacactttctggtatttcagatgctacaggcatctccatggctaaattagcttatgataataatatacaaaatatcgacttaatctacgctggcgataccttagttctaaatcgtgatggtgaagtaccatcggattggcactattacggtgatggtgtttatgttgctaagaccaaggtaactatcaataacttcgttgataatagccataacacggtaaacattaatgtttcaccaataagtcatgaagaaggaagttcatctagtaaatcaaaagatgatagtaacgaatatatatctgatttagatccagatggtaagaagggtgaagcagctagtgatactgatagttcatcagattctaaatcaagttctaagaatcatcattcagattctaaatcagatagcgatgaaatggatgaaagtgacttctcatatgcagttagcaatgaagtatctagtaagttaggtttgaatgatggcaagctaactgtagacttcactggtaaagatgatgactccgattcagatgttaatactgatgatacaagtgacgactctgattcagatacagaagatgtttatgataataatcaaaatatttcaaccggtagtgataagcttacagatgaaaacgctgaaaaattagctgacaagattgttgcacaacttaaggctgatggtaagactaaagatatcgataaagcggataatgttgaattgatgattgaagctaacgatgatgactttagtttcaatgtaactttaacaactaccgatgattccgattcagatgaagacagcaatagtgatgatagtgatgctgatacagatagtgaaggtgcagattcagaagataccgatacagattcagaagacgtagactcaagttctgatgaaagctccgatgaagatactgactttgatgacgaatcagaagacactgatacagatactgaagatgaagatcaaaactcaagttctgaagacgaagatagtaataaccaagtcacaactaatgatgacgaaaatacagatactgaagaataattaaccgagaggaactttggctgatgaagaagaaatggacagttattgggatcatcgttgctgtgatcgtaatcgtatgtggcggtgtgtactggaatatgggacactccgtagctaaaaaaataccgggtaacacttatctttaccagagtgtttcaaaagataagactttatatgttacctttgctaagagtggtgatcgggccgtagttaattccgataaggctactgccctcaaggcaggtaagagtcaacaagattttgacaaagaatataaggctcaatctaagttaacttcttggaattataaagctgaaggtggaactttaactctggctcaagaaactaaagatggtaaaatttcacaatggcaatataacggaattttagcgacaagtaagaaatttactgcccacagttttacttatcaaattgctaaagctggccaaggtcaagtgaagagtaagacggtatttgaaaagattaattaacttaatttaagttaaatgaaactgcgctaaaaggtgataaaagtctccaaagaggatttcacctgatggtgcagtttttggttactctaagcctaaagtagtagattaattaggacatagcttgctggaaaattaaaaagttgctatgattaggttaaattaaaacggaaatcaccaccggatggtcaggcatttgtaaagctcattaggtcaatgaagagctttacggatgccttttttattttttaggaggaattgaagatgacatggttttatttagttttggcaggtatttttgaagtcgtatgggcaactactatgaagctcagcgaaggatttagtgttctaacatatggaatcgcgaccgcagtggggatgattatgagctttgtatttttatcattggcgattaaacagatgcctcttagtttagcttatccgatttggacgggaattggtgcagtgggttcaatcattgtcggcgtaatcttatttcatgatcaaattcctaatattacgtgggtttttattataatgttgattgttggaattataggaattaagatgactgcaggacattaaaacggcggaggatgtaggagtgcaaaaacctaaaatagttattgataatttaccagaggagtcattttttgagatttacaaggatgaagaccggatgctgataaatcatcaaattagaaatcaaaatgctgaaaagcaattccttgaacggggcatcatcgaacaatcttactttgaacacgttaagtttaatcaaagcgatttttatcggctagagttaaccgactcgatttttgttggctgtgatttttcaaactgtaaaatggaagaagcagttttttatcgatgtgaatttagaaattgcaagatgttagggatcaacttgaatggcgcaatttttaacaacgttctgttagatgggacgaatatgcagttagcagctctaaatcaaatgaaagttaaagatacaatgttcaatgcctgcaatctaaaagatagtagttttgctgaaaataaactacaaggagcagttcaatttgagcattgtgaaattgatcaaatgtccttttatgatacatcgctgaagcatgttaatctcagtacatgtttttttgaaaaaattgatgtagaagagcgtttaattagaggaatgcaagtcaatgctactcaagcggcccaaattgcgcaatatctattaggtttacgtgtagaatattaaaaaactacgactttaggtgattttcgaagtgaatttcgtacttcgaaggattcattaccttttgtcgtagtttatttgttattattattatgttcgtaagtaaccattttcttgtttaacagctaattgaccaactagatttaagtaattgaaaggttgatcaaagttcggagaaaatagcatatctataaaggataattcgtcaatcgtgccgtgataatgcattaaggctgagattgtatccgcagcttgagaaacatcatgtttgctccagagttgtactcccaaaaccttacgggagttacgatcgtaaactaattcgatttcaactttgtgagcattaggcataaagtctggacggtagctacctttatatgccactttagtagcgttaattccagcatccaaagccatggctaaggtcacaccactacaagccaaagtgcgtccgaagattagcattccagttgttgattgggtaccaattgaacggaggcgtttatctaacacattaataccaaccaaggccccttggcgaacggcttgtgatgctaatggcatgtaaacatcggtttgcaaaccattatgtttaactgaagcagcatctccagcagcaaagatatcagggttagatgtttccatataatcattaacgacgattgctccattagttagttgatctactttaccttgtaataaatcagcttgaggaagtaagccagtacaaattacagccatatctacttcaaacgcttcgtcggcggtttttacgattaaggtatcgtcagcgccatcttcgaaggatttaacaatcgtaccagttttgacctgaatgcctttatcttctaaaagattggtaattttgtcagcaatttcaggttcgatatgacggtctagtagagtctcttttttatggaaaagaataacctcgtggttagatttattgtaaccttcagctaattcaacaccaatatagccaccgccaataatagcgattcgttcatcattttgggcttcgttacataagtcacgagcttcttcataagtcttgcatagctttactttgggattttcaacgccttgaatagtaggaatagacgtgagtgaaccagtagccatgattaacttatcgaaagattcggtagtgaattctttagtctctaagtcttgagcaaagacggtatgttcttcgacattaatatcaattacatcgtggcgtagacgcatgtctatcccctgagcccggtagtagtcgggatcagcatacatcgcttcatcaagattagatattgtttttcctaatgttaagtaagtggcgcatgataagtatgaaattgtatcgtgtcgttcgaaaacagtaacgtccgcttgtgggtggtatttcaagatttcattgactgctgcaataccagcatgggtacaaccaacgacgattattttttctgtcatctgtaatgacacctttttttatggtatgaattatagtatttatatagtatactataacttaaacgttatacatagtatagtatatgattaatttttttaaattatcgaaggaggtattctaaatgcctaagtatcgtttttttgcgcaacaacaaattaatacagcaacgaatgccgttttaggatacgaactattaattaagaagctaactccagatggctggcgcctaccgagttcatttattgatattgatacaaaagtttttgctaacttattgatagaaacaactaaaatattaggccaaaaggttcgctattgttcagttaacgttaaccgtgaccaattaatgaatactgctattgcagaagcaatcatcgaaagtcaacgtcaactttatccaaccaagttaatcgttgaattaaccgaagatgttagtgaacgtgaatacacacctacagaaataaaagagcaacttgaacgctttgtcagcaaaggaatccaaatttcacttgatgacgtgggtacaggacacaatcagtttgaagatattgaagacttccttcccttagcttcagaaattaaatttgccgttcaaaactttaagtctacaattcaagatcctaaaatcaaacaaaaggtccgtttctggaacgcgattagttctgaatacaatattcatttggtattggaaggcaacgaagaccaagcagacaatcagctaagccaaagttttggtattagccgccgccaaggttatttcttcagtaaaccacaattactaagccttccaggcgataaataaaagtcaaaaaaactactaacctcaaaagttagtagttatttttttacaattttttgctctaagataagcttatataaaacggttcgaatagctatttctaattgagaaaatgacgcgacgggttcttctaaatggctgatttcatgattaaaacgcctaataaattggttgaagtatgtttcaatatcatctgtagctagcaattgtttgatagtatctagcgcaaaagcagttttaaaaatgctaatcatcataatagaagcaatgtggctagcgttatacttctttttagtagggcgcgtcacaatttccattttgacgtaactattgaccatggttttggtgattttagtacctaagattggtgtcaagtagcggttaacttcttgaatgacttggtccatgtataaatcaaggtctggaaagtctttaaattcaggcaaacgaagttgtttaaaatcctgtagccacttttgataagtttcttctgtcatcgataaatcctccagctagtatcatagcataaattttattcaaattgatatgcatttcgctttacgtagaatacgattctatgtataatgacaccaataactacataatacgaaatgagggataaaaatggtgcaaacacgaagaaatcagattatatacgaagtttggaatgctgtgacccatggtgtggccttttttggtagcttaggcttagttattttattgattgttaaagccgtcacgcaaaatttatcatccaccgctattaccagcttggttatttatggagcaaccttactaatgttatatttggcttcgacgttgtttcactgtttagcatttacgaaagccagacgagtttttcaaattttcgaccatagtaatatttttttgctaatcgcagggacttacacgccatattgtattatttttgtcggcggaactagtgggatattgatgttgagtatgatttgggcaatggcgttggcaggaatcatcactcatatttggagcaaaggtcgttttcaaaaggtggaaacaacgatttatgtgattatgggatggatgtgtttgttagcagggaaggcgctatatgctaacttatcaccaactggattttggttgctagtcgcaggaggcgtggtattcaccgtgggagcggtgatttatagctttccgcgcatcccgggactacatttgatttggcactttttcgtgatggcgggaacgatgctcatgtttggatcaatttatttgaatatataggaagtaatcagatcaaaacacaacaaaaagagatttcagtatcgactgaaatctcttttaaaatatactaattaatttagatataattgataggcaaaacgggttgtatcaacttcattttcgtcattgaagtcgataatgccacgatattcgaaaccattattagcaataactttttgcatacctttatttttggggtgggtatcaatacggagttcattgtagcctagttcggaactaattgtgaaaagtccggacatcattttttcagagagtcgttgaccgcggaatttagaagacatcgcaattcgatgaatagacatgtaagtatcttccggattacctctccaacttccttccaacatgtcatcgtaatttacgtctcgatcaggccataaagaagcagtggccgcaatttcaccgtcgaccattaaaacatagctaattttttgttcaatatctttttcaatatcttggttagtagggtagccaccttgccactgattaattccttgttccttaaggtaagctttggctgcatcaattatttctaaaatggctggcaagtcagccttagttgctttgcgcaagtaagatgttgtcataattattctccatttatttttttatcagaaatgctattttaacgtaaatgaaaagagttgtcattactttttatagatgaaaacgtattcgttatttctcaaaagatttttggaattaacctatgattaatttttaattaaaaatatgataatatagtaaatagcataaattttaggggtgtgaatatgaaaaaagttcggaattggagattgacgctggggtggcaaatcctgataggattgatcctaggagtggttttaggtgccgttttctaccataaccaagttgccattacggcgatgcaaaatattggaaccatgtttatccacttgattcaaatgattgttcttccaatcgttatatcctgcttaaccgtagggattgcgggaatgggtgacattggagaattgggtcgtgttgggttgaaaactttgatttattttgaaattctaaccaccattgctttagtagtcggaatgatttttgctaacgtttttcatccaggaacttatattgatatccatagtttgcaaagtacggatattagttcatacgtggaaactgcaaaacacgctaaagaaagcagtggcctatggtcaacgattatgaacattattccaactaatatctttagttcgttatctgaaggaaacatgatgcccatcattctattttcagttctttttggattaggaattacggcaattggtaaacaaggacaaatcttgattgatggccttactgctatccaagaagtaatgtttaagattaccaactggattatgcacctttctcctattggggtttgcgctctaattggggtaacaatcgctcaaatggggattgatgctctaaaaccattaggattgttcatcttgattgcctacgtggcgatggtattctttgtaattgtggtactgggaattgtggctaagattcaccacgtgaaattcttccagttgctaaaggtaatcaaaaatgaattgattttagcattttcaacagccagttcagaggctgcacttcctaaaattattgataaaatgcaaaaatatggtgttagccaaggaatcgtatccttcgttattccaactggatacacgttcaacctggacggatcagctatctatcaagcagttggggcactcttcttagcccaggcttatcatattaatttaagtattggacaacaaattacactgctagtagtattgatgattacttctaaagggatggctggtgttcctggtgcttcatttgtggttctcttagctactgtttctaccattggtgttccgatagctggtttaacgtttattgctggtgttgaccgcattattgatatgggtcgaactgcggttaacgtggtgggtaactcactagctgcaattatcatgggcaagtcggaaggcgagttcgatgaagagaagcatgcagagtatgtaaaaaatatttagagtatgaaataaaatacagcgaaaaaaggcgaccatgacattaatgtcgtggtcgccttttttcgctgtattttaactgccaagttcataagtaaagttgattaatcgactgccataacttggatggtggttaagttgtttaaccgttttttgtagaagttcaagtttatcggtgataatgccatcgactcccataaagttcaatctggccattgcatcgtcactattgacggtccaagcataaacttttcgaccagttaattcggcagttagtaaaaatgagttatttaaagttgaatattccatcgtgtaaaaatcggcgctagactgtggaactccaataaaattgaaaggcagaatatagcccacggttaattttggattaagttctttaagtttttcaacggcatcataatctaggctatggacttgatcatgattttttagaattctttgtccatatttagcattgaaacgctcaaccacttttggatcatcgtatttagtagttttaaattcaattagtaggggttgtttaaacttttcagcagcgtccatgtaatcatctaagctagctatcttagctgaacttccattttcatgcgcagttaatttggtgagttgctttaaagtcagttggtgcggcgctttatcaaccccggttaaatttttaagattttcatcatgcattaatacaaattgatggtccttagtttcatggatatcaatttcgatgaaatcaggatgtaatcgactagtattcttaagggattcaatggtattttgcaccccatttttagcgttaaccccgcgatgagaaatggtaatgggagtgtcactaaaaaatccagttagatacaacgaattaaatccaatgcccccgataacaagtaaaccagcaataattcgaatccaacgttggtttccgacgttgtagctaagttcttgaagctggtcgcttaatcgatgagtatgggcagtaaagcgctgatctccagccaggtattcagtcatgatcatcaaagagccagcacccgcggcaatgctcgaaagaaacataaaaaattcaatcaaaattaagtttacggaagcggcaagaaaggccactccggttggtgtcatacggtcgaaaagggtttgttcccctagtactaaaagctgcccagcaattattacaacaatggtggtggcaaagagtaatacaagtcgtaaaacaatcggcttaaagttaatcttagttatttgccaactctgttttaccgcagtatgggcgttccgtttacccaaaatgattaatggtagaactaggaataagcgaattccgagataaaaagtaaccacgtatagcaaaatcatcactaacaaaagtggacgattttcagttaaaaaataatcaactaggaaactaggaatcctaattttatttaataaaggtgtcgaaaaacctaatccaccaaaaggtaagattaaaatgcagtagattagtaagaaccaaacggaacgaaaaaaggtcttacggacacgttgaacggaaagccgtaagagtgaatcaatcgttaacttctttccataattaatttgcatggttcctaaaaatagaaatgtgacttgccaatagatggccacaattactgctagaattaaaagaattaaacctaaatctaaaacaggatgctggctaataatttcaattaaattggtattagagatgtaacgaactcttgccaaacgtagcattacgctcccaattagtgtaaaaattgggattaaaattccgtatacagcaactgtagaagcaataaaaagccaaatatagctaaaaatgtgtttaaaaatataacgataagttttcagagtactcgacatgattctcccctaagtaattttttgtgtgaatttgtccaaaataaaaggagctacaacaaagtctaatctaaatcggatcaaggttaaaacttagattaaacgtctttgtcgcaactcctaacagttatttttcagttgtggtaaaagctttagtctcagtattgtaaacatgaacatagatatgatcaccatattcttcaaagaaggtgttttcgtcgttggcactgggataaaagaaactttcattaccattaatatcaactttaattccgggcattggtgcttccacagtctctaaacgggttgttgtggttgataggtaggctgcgatatatttcttgattaattgaagttccatagttcctcctgattatagtacgtttttagtttgttcggtatgaataatgtagttattgatcagttctgatgaaacagcgggagttttcgacaagatggtctgagctactactgattgggagagttgctcctgataaaaatcattgggaataaattggctgatgctgagaatgacaaaggaaattccataagtaattactaaaccaaccaccgcgccagctagactatttacttgatggataactggtagccaagtaaccatttgcgataaacgccctactaaacgaataatgatccagccgatggacattagtagaataaaggcgacggaatgcatgactgttaaattagtaacttggttactagtccagcctccgaaagtagtagttaggaaagcagcaaagtcattggtaaaaactttagcaaaaataaaaacaacgatataacccagtgaatacaataattccaggatgagccctcggcgccagccgcgagcaatcgccataattaaaattaaaattattattaaagatagtagcattaagagctcctttacttaattagtagttgagtctgtgaacagattctcccgtatatcaatggacgagagaatcctaagtatctaaacactatagatgaaaaatcacttgttttcaagattgttgtacttcatttaacttcaatttaacctaaatatagccagtttaaacgggatttataaaagatttaaaagaactttacaattccggatgaaaagaagtagaattagttgtcagtttaaaatgattctaaattagaacaaggggatagtaagatggagaagaaacaaaaagctggaacactcgcacaaaaaatcaatatcatccgagctagcgtaatgggcgcaaatgacggcattttatctgttgcgggaattgttttaggggtagctggagccaccactaatagttttgccatatttatatctggaatttcggggatgttagccggaacggtttcgatggccatgggcgaatatgtatcggttaactcccaaaaagattcccaagaaaatgcggtcaaagttcagcgtcaagctttaaaagatgactatcaaaaagaattggattttgttgctgaaaaatatgcgaatgacgggattccaacagacctagcccagaaggctgcgttcgaaatgatggaaaaggatgctcttttgactacggtccgtgagcgatatggttttgatatgaataactttaccagtccttatatggcggccatttcctccatgatttcattttcattgggatccttgttgcccttgtttaccatcactttcgctaaacatagtattcgtgtgcctttaaccgttatttcggttgcgattgccttggcagttactggttatgcagcggcagtcattggtaaagcggttcgtagacgagcagttttgcgaaacgtcttggcaggtttaattacaatggcgatgacatacttaatcggttcgctatttgctagataagggggaaaataagcatgaagaaaaaagaaatcagtttagacaataaattaaacatgctacgggccggagtgctaggtgctaatgatggaattctaacggtggtcggtgttctttttagtgtaattgcagcaacgactaatccatttattattttcattgctggattatcggatcttttgtcctgtgctttttccatgtcagccggcgaatatgcttcagttagttcacaacgtgatactgaaaaagcggtagtgggtgaagaaaaattacgtttgcaaactgatccccaagctgaacaagaattaatcgcacgtttttatgtcgataagggtgttagtgaacaaacagctcatgaaatttcacaagctttaatgcaagaaaaaccactaaaaaccgcggttagtgtacgctacgatatggatattgaagattacttgaatccttggagtgcagctgtttcatcattgatttcagcagctttagggggcttcttcccgttagtagcgatgtcgatggcaccaacttcttttaaaatgcaagcaacgattatagcgaccgtcttttccgtagcactaactggttttttgagcgccaaattgggaaatgggatggcaaaaaaagctattattcgaaacgtgattgtgggaattatcacaatgtttatccattactacattggaaaattattttaaaatttttaagaaatcgttttcgagcttcatctatcaagcttttcttaatcattgaagccacaaatgtccgtctaacggcaataaaaagagtttgcgcatcgtgaacaatatgttacgataaccgtggttcaagattgaggaaaggaatgattttgatgagtaatgagatcaagagcccaaagaaacgtcgcaaattagtggaatacgctaatggacgatcattggaagaaataaatgggacagttaaggtgcctaagaatattggtttttggaaggcactgtttatgtattcgggtccgggagcattagttgctgttggttatatggaccctggtaattggtcaacatcaatcactgggggtcaaaacttccagtacatgctaatgtcgattatcttgatttcgagtttaatcgcgatgttgttacaatatatggcggctaaactgggaattgtgagtcaaatggacttagcgcaggcaattcgcgctagaacaagtaagtcattgggaattgtattatggattttaacggaattggcaattatggcgacggatatcgctgaagtaattggtgctgcaattgcgctgtatttgttgttccatattccgctagccattgcggttttcattaccgttttggatgtactgctattactgttattgactaagattggttttagaaaaattgaagccattgtggtgtgtttaatcatggttattttggtggttttcgtttaccaagttgctttatcaaatccaaattggggtgcggtatttagcggcttagtaccaactactaaagcatttgaaacttcaccaacaattggcggaatgactcctttaagtgggtcactaggaattattggtgcgacagttatgcctcataacttgtacttgcactcagcggtttcacaaacgcgtgaaattgatcataacgatgaagaagacgtagcaagaacgctacgcttctcaacttgggattcaaatattcagctatcattcgcatttatcgttaattcacttctattggtgatgggagttgccgtatttaagtccggcgctgtccaagatccatcattctttggtctattccatgcgttgaatgatacttcaactttgagtaacggaattttgattggagttgccaaaactggggtactttcgacattatttgcggtagctttgttggcttctggtcaaaattcaaccatcacgggaacgttaaccggccaggttatcatggaagggttcattcacatgcgaatgccactttgggcacggcgtttgattacccgtttgatttcagttgtaccagttttgatttgtgtcatgattaccagcggtaaaggtgatcttcaagaacacgaagccctaaatcagttgatgaataactctcaagtatttttggcttttgcattaccattctcaatgattccattgttgatgatgacggatagtcgcgttgaaatgggtgatcgatttaagaatagttgggcggtcaaaattttaggttggatttcggttattttcctaacctacctcaatatgactggtttaccaaattcaattacggccttctttggagctaatccaagtgctggtgaagtagagctggcgcacataattgcctatatgctagtggtagtagttctagcactcctagcttggacagtctttgaactccataaaggtaaccaacgttacgaattggaaatgcaaagtaaagcagaagctaaggaggaagcataatgacctttgatgttaagagaatattagttggtgtagatgattcggaagatgccgttttagcctttgattatgcaattaatctggctaaaaaatcgggttctgaattggtaatcgtatcagttttggaaagtgacgaaatgaatgtttttcaagcgctagataaggactttattcatagagaacgggccgaacttgaacaacatatcttaaaatatcagaaaaaggctcaggatgcgggagtccaaaatgtaaagggcgtcgttacggaaggcgatccgggcgagaccattgtggaagaagttattccagctgtccaacccgatttgttagtggttggcgcagagtctaaaaaagggttagcacgacattttggtagccaagcagcctacatggcgaagtatgctcccatcacggtaaccgtggttcgataatataaaaaatggatcaacgctttgattgcgttggtccattttattttgagttaaattatttaggtaccataacttgaacgaagccttgctctacgccaagtttgatggggagttggtcactaggatcaccatcaattcgagtttcaaccttcaagtgtgaatcaacggcagaaatttcaacttcctgagcggtaagttgatcaacatctttgatatctcgaaaacgtccagttaggaaataacttaggtaacctaaaagacgcatgaatgaaaaatgtttcaggataaccaagtgaatttttccatctgctggagatgcagatgtatcaaaattagtaaaaccacccactgagttggtagtggttgctaataggaaacgcgtgcgatagacgtggtcgccatccgcagtactaactttaatctggcaagatttcttagcaattaactggcgaattcctttactcaaataaattaaaggtccccattttttcttttcatcttgtccgacatggcgggccatatcagcaagggttccaagtgtaaggctactaatgatggcatggtcttcagtatgggccaaatccacagcgaggggatgaccattaagaatggtatcaaaagcagcctcctcatcttgaggaatttcgagggctttagcaaaattattgacggtaccaccaggaataattcccactttgactgattttttagccttaaggaaggctgaaaacacggtattaatggagccatctccgccaattgtaataactgtatccagttgagcaatatgatcaactacataatcgagcgcttcttgacgactagacgtggcctttaaggtggttgatcgcttcaatcgttcagccgcttgctgaaaacgttcagcgatggatttattatcattttttccagcatcttcattataaataacggtatatttaggcatcagagcctccttgttgagctaaatttttttgtaaagtatctaaaaataatcgatttaaattgggtaaatttcgatttttactccaaatgagtgtgttcgcttctgacatgtcaggattaagcgggcgggcgaccaaaccgcttgctggtgaaacgtccacaagttgatcatataaaagtgcaattgctgctcccgttttgactagtaaactaccattaaaagccaaattgaaagttcccacaaaattaagttgatcataaagggtgttactccatttttggaataagccgtgtttgtaagcctgacgtgaagtaattaaaggacgaccgactagatcaataggtcggattttttcctgttgggcgagcggttcatctgctcgcatgatggcgcaccaatgatttttagctggtaaaaccaaagtgttgtaattattaagggggcgatttcccataataatgccaaattctaaaatgcctgcatcgaggtcagctaagatgggttccgcatccgcactccgaagattaacacgaacatcggggtattgacgcatgatttgctgggctgcctccatgactggcataatccccacactttctcctgctccaatgtcgagcgtcccactaactacatcttgtttttgtaagttataagtagttttatcaactaaaccaataatttgtagcgcccgttctaataggtaatgaccttcctgcgtaagttgaatatggcgatgggcgcgagtgaataatttggtccctaattcatcttctaaatcagcaatttggcgtgataaagccggctgggacacgttaagtaaagtggccgctcgtgaaatgttttgttcctgagcaattaccacaaaatagcgtaagacacgaatatccataatattttcctttaattcataactaaaagttattgtttttgatgtttaataagtatttaacattatagtaacgatcccgtagactagagtcaatcaataaggttaggaagcggggtgagttaatgcaatccaaaatggatttgggaacagcggcctatgatggtgtcgaagaaatcgtagctaaaaaccaacggttggttcagcaattaaatactggagttcattcggcaaatgaagtacttagcattgtaagccaaatcactaacgagcgaattgatggttcgactgaaattcgattaccttttcaaaccgattttggtcgcaatctccacattggtaaaaaagttttcattaatagcggatcgatgtttgtggacttaggtggtatctatattggtgatcacgtcttgattggtccaaacgtaacgattgcttccgttaatcaccgtctagaacctagcgagcgccgtaatctagatttagactcggtttgtattcataataatgcttggttaggcgccaatgtgacggtaactcctggcgtaattattggtgaaaatgcagtagttgctgcgggcgccgtggttacccgcgatgttccacccaatgcggtagttgctggtattccagcacgcgtaattaaagtaatcaagaatactaaggaggatcaaaaataatgagtaataagaataaagtagtaatcatcatgggcgcttcgagtggaatcggagctgcgacagcagcaatgctagcgcaacaaggagctaagcttagcttggccgctcgtcgtctggatcgattacaagaaatccaagctcaatatcctgaggctgaaatcgaaattttcaaagccgatgtaaccaatgaagatgaagttcaagctgtaattgatggtacggttgctaaatttggtcggattgatgtgttatttaacaacgctggaattatgccagttaataatttaaatcaagttgctcaaaatgaatggcaacaaatgttagatattaatgttaaaggtgtgctaaatgggattggatcagctctacccatcatgcgaaaacaacaaagtggccatgtcattacaacttcttcggtattaggctatgaagttttaccgggttatgcggcttattcaggtactaagtatgcggtccgcgcgattatggaaggtcttcgccaagaagaacaccaaaataatattaaaactacggttattgctccaggtaccgtgaaaactgagctatttaactcaatcaataatgaaaaaattcgtaatgaattgaaggatgctcaaaaattaccgggagctgaaatgacgggacttaatccagaagaaattgctcaagcagtggcctttgtgattgacacctcagctaatatggctgttaatgaaatggtaattcgtcctacaggtcaaaccgtttaattaaaggagaaatgataatatgaatgtttttgaagaatcgtacaaattaagtaatggtgtaaaaatccctaagttagctttaggaacatgggaaattgatgatgatcaagttgctgacgctgtgcgcagcgcaattgaaatgggctatcgtcatatcgataccgcccaagcttatgctaatgaacgtggcgtaggtgaaggcgtacgtactgcaagtgttcctcgtgaagaaatttttgttaactcaaaaattgctgctgaaattaaaaattatgatgatgccaaaaagtctattgatgaaactttaaacaaaatgggtctagattatttggatatgatgattattcataacccccagccctgggcagaagtaaatcaatccgatgatcgtcattttgaaggtaaccttgaagtttggcgtgctcttgaagatgctatgcatgaaggtaagcttcgtgcaatcggtgtttctagcttccaaaaagaagacttggataatttaatcaaaaatagtgatactaagccaatggttaaccaaatcttatcgcatatagctgctacaccagtggatttgattaactactctcatgaaaatgggattgtggttgaagcattttcaccaatcgctcatggacaagcacttcgtagcgaagctattcaaaaaatggcggcaaaatataacgttagtgcaccacaattatcaatccgttacgattggcaattagatacggtagtacttcctaaaacttctaatccggaacacatgaaatcaaacgccgagcttgattttgtaatttctgatgaagatatggaaattttgaaacaagttaaaccgctagattacggggatgcaagtgtctttccagtctttggtggaaaaatgtaagagtaatatcaatttaatctaaaaaaataatctaaggttggtcctaaaagggatcattcttagattattttttattatgctgttttgggagtagcctgaacccagtttttaagtaggtagatgttaataattgaaacaacgatagtagtaaggattagataaataaacgatagatagaagttagcatcagacgtagcttgagatgaagcaaaaatcatggtaaaggagtttgttgctaaattacttattttacctaatccgtatacaagaacaatgattaaaacgactcgagaaatgcgttgaatatttattggtagaaaatcactaaaggtattcgttagtaagtgaactaaactgactgagcaccaaatgaaggttgggaaaatcaaaatgattccggcccctactgcatattctaaaaaactaccattattcatgattggaagaattttgacaaaactagtaggacccataatgaacgttagtagaactaccagaatttcaaagtaaatccaactaaaaaagtttgtaagtacattaccgatatatagcttagtttccgaaagcggtaaaagtcggtagaggggagccgtccaaacccgttcttgtttaactgctagaataacggccagtaccaatgaggccaatactccgaaactaaagctaaacattaaccagtcggttattctaagtccatgaattaaggtttggtagaaacaagtgactagggtaactagtagatagatgccaaagaccttatgaataagatttactcgggttttcaacattgttttcgttaattgtgagaaagtggtcatcttaaagctcctctctataaaaatcttcgtagtaagtttcaatatctttaccaagggtttcacgaatagtgtctgcggcttcttgtgcagccacatgttggtccttaataatgacgacttgatcgagcaggttagcaatatcaccgacatgatgatcgctgactaaaaccgtcgcattttcaggcttccattgaataatactggagatgatttttttgcgtgtcatactgtcaatcccgtcgaaaggttcatctaataggtacaaatcagtttgacgagcaagcgtaacagcaattactaacttgcggaaattccctttagaaagttgattaacgcgttggtcagggctcaagtttgttgatgattggacaggcaatttcaccttctatggtttctgctaagtctttaaaagatagcgggattgaagttggaattagtatgacagatccaattagttctcaacaaaaagtgactacagtgatttccattcaaggttctgaagatgaaatgagtattggcagtaaggtaatcgttaatattccaggaagtactgtacaaagtggtgttgagggcattaatttagtgggagctggattacaaggttttgatggtccgacaatcaccaaagttggggataattatcaattagtatatgttaaaaatagtgaatcggttgctggtggtgaacaagcgactatttcttggacttcacccggatggtatccaggagatgaaccaggagaagtagaatccactattaaatatgaagatgctcaagatactagtaaaaacgcctcagatagcactcagtcaaatactaaggggacacttagtccggctaagccagattttggtaaatggacaatgatggctaagactgatgatattccaaattacaaaggtgtagcattaatgaatcctagtaattcggcggtaaatgtttatgacctacctgtaaattacggtaacaagaaaatgagtaatgcaacagttaaagacgttttgccagcagatactcattttgtatatccaggtatatcagtgcaaacagatcttaaaactaccaataatattcgaatcttaaaactgaatggcagtggttttactaacgtcacagatcaatttgctggtgggattaaagtaaatggaagaaccttatcagtagattttggaaatgccatgaatgatggttctgcatacgtcgtggaatatgcggttgcaccggatgatggtcagacaccaacaacctatggggtgaaagcaaattctgcagaattgaattatatggattcagaaggtgattctaaacaagccaccgcttcgctgaatcaagcaattgatgataatagcaatgggtccttcaagtttacaaaagaagtaaaacaaactgaatatttgatgggatcaaaacatttagattacacaatcaaattaacaaataatcataactttttaattcctagtgggtcaataattgaagatgttttaccaatgggattggattatgtttcaactgataatagttctacagcagttgatgtaaaacctagtgtcgcagggcaaaatgtgcaatggactttaaatcaagacttagatacgggagagagtgcagtcgttcattttcgtgtaaaagtggatgaatcacaattccaaccaggagagaagattaataataaagccgtgttacatcgggtcgggagtaaggacattaatagtaatactacaactattttagtgtttaatggaaaaattaagatcagcaagacagatgccgaaactgaaacggcattagcgggggctgaatttgatatcctagatcaagatggaaaagtagttgaccatgtaaaaactagttctgatggggccattattagtaaaacattacccacaggggattactctgttaaagaaactaaagccccagaaggatacgaattatcagagaaagactatacagtacatctagattatcaacatgctaaaaatgggatagttgaagtcaatgttgaagatattccagataccacaagtacaacggatacaagtgatacgacagataccacaagtacgacggatacaagtgatacgacagataccacaagtacaacggatacaagtgatacgacagataccacaagtacgtctaatagtacaaagaattctgttcctaagttgccaggaaaaataacttctggttcttcgggaacaagtacgtcgaaaaaaggtaattctacaagtaaaaaatctagtggattaaaatcacctttagctagcctgctaccacaaacgggcgaaaagggtggatggattttaacgtttgtaggtgttgttatattaggagtagttggctggtttgtatttaagaaaaaacggtaagttttaggtactaaattaattgaaatgacactaagtttaaaaccgagcagatagctcggttttttagtaataaaagaggaaaaggattagaaaatatggtaaaaaagttgaaaaatggtagttggtacttaatgagctttattttacctataaccattgtcatcatagcttatgcttcaaacggaatatattggggtagcgcacatagtattctggcaagcgatgcttttacacaaggcgctaattttttagccagttttcgagaggttttacatggaaaaaatagcttgtggtttaattggcaagccggttttggattgaattatttagcattatatagttactatctaggagggatagtaacgcctttagtaggactatttagcaaaaatcagattccaaatgctttttatgtaattacaatatttaaaataggattagctggtctaagcagtttttcttatctaaaatatcaatttaaaatcaaacgataccaacaattattactcgcaattagttacgctaccatgtcttttggattagtaaatgcagaacaaataatgtggcttgatgttctctatatactaccactaatagtatggggagttgatcaatggatagaacagcaaagatggggattattgttcattagttggttcttaatgttagttactaatttttatattgcctttatggtgggattatttatcggaatatattatttaatgaggttaataacattaaaagtacaacaatggtggattaatattggacagtttattggaattatgctctggtcaacaattagcagtggagtaataattttacctgtaatcttatctttgagccgcaataaaatgccattatcatcaatgaatggtatcttcacagatcgctctggattatgggatttaccagttaaatctatgataggggcttatgatggtactaaatttgggactaccccttatatttatgtggggctaatagtcttaatttacgcagtatcttacttttttaatcggcagattgcacgacgtgttagggttggatacgcagtattattactaagtttgattagtggattctatctacaatttttcaatcttacttggcagggatggcattttccagcgatgtttctataccgttatagttttttatggtcatttgtaatgatgcaattagcagcgtatgaattggaagttatggtatctcgccttgaagcgaaaattggtattattttaggcagtgtgatgctggtggcgactgtggggagttttaatcattatcactttattagcatttggaatttagtagctaccttattatttttaatagtagaagtactactaatctttagcagattaaataaaaaagtagccataggaagtttagttttagttagcattttagagctaacgatcaatgcgggtttaatgtttaaaggggtagctacagaatggcattatccaagtgcttcactatttaatgagccagcaaaagcaatcaaagaagggcttccaaaaataaggaatgatagactgcgccgagtagaaaacctagattctatctcacgtgacgacggtttgaggtttaattatgggtcggctaatttcttttcctctgtaactaatcgaccatttgagcaaaacttaaatcaattaggttttcgttcaactggaagtaacctaaacatgacatatggaaataatactttggtaatggacagtattctaggtattcagacgaacttagcgttgcaacctgttgataaatatggttttcagatggcaactcgttcaggaaaattttatgtaagtaacaatcaaaatgctttaaaaaatggaattgtagtagagcaaaagcttgcggaaaataaaaaattgagtaaaacagataatttaggtaatcaaaaccaattattgtccttagtagctcatacatccgttacaaagcggttattcaagagctttccggttcaattgaccggctctacaggacaaactgctgaagctggacttgaatttaaaaatttagaaaatggtaatcaatctcttaaattatcagtgactgtcccaaaaaatcaacaagcctatttgagtttatttaaaatgcaaggaagtataagtcaaatatcagtttacaagggaaaacaattaattgagaactataatccaaatttggttgggcagtatattaatctaggatctttcaaacaaagaacgaatctcaatattagtgttcggctaagcggaacagggacagctcaatttgcacgcccaactttgattacattaaatgaaaaaattttccaacagcaaatagaactagctcggagatatcaagccacaaatttaaaatatgggaaacggacaatcaaagggaatatcactacaaataacgataaacaagctttattattaacgattccagcagatcctggttggaaagcaaaaattaatggcaagcaagtagcagttaaaacagtagataatttatttacactagttcccttaaattcaggaaaaaatcagttaactatgaaatatgtaccgactggtttagtgattggagcatggttaacaatacttggtctatcaagttttatttttgtacagatctggagacgatacgataatgaagatttaggttaagtattggtatttttatagtaagctatttaaaatagtgaaagtaaattaaaaaagtgacttattttagatttatctgaataggtcgcttttttagttggataaggcgtatcaagtgcttttttgggtaaaaaatgttttagtcttagttataaggaaaagagactatttccaaaatagtacttaaggagagattcgttatgtatgaagacttacaaggaaaaatagctgtaattacgggtggttccaaaggtattggctcagccatcgctaaacgttttggtcaagaaaaaatgaaagtggtcattaactacaatagtgatccagacggagctcaaaaggccgccgacgaagtaattagtgctggtggcgaggccgtgacggttcaagctaacatcgctacagaagccggcgttaatcaattacttgaaacggcgcttgaaaaatttggtgacctagatgtctgggttaataatgctgggatggaaattaaatcaccaactcatgaagtatcgttagaagattggaataaagtaacggcaattgaccaaactggtgtatttttaggttcacgtactgctttagcctactttaagaagaaccacaaaaagggaaacattattaacatgtcttccgtgcatgaacaaattccttggcctacctttgctagctatgcagcagctaagggaagcgtaaaattgttcactcaaacgattgcgatggaatacgccaaggataatattcgcgtaaatgccattggacccggagcgattaatactcccatcaatgccgaaaaatttgctgataaggaacaatatgatcaaacagtcagcatggtacccatggaccggattggtaaacctgaagaagtagctgcgggtgcagcatggttagcatctgacgaatccagttatgtaactggtattacactatttattgatggtggaatgacgctttatccagctttcaaggatggacaaggttaagaatcacattggggtaaataaaaaagaccgcgaacggtcttgaaaataataaatattgatgtttaatcatcgcaagaatttggccgccattaattttgcggccaaattttattaatctcttttaaaagtggttggacgagcttacggttactttttaaatatgaaccgtagaattcaagacgattacgaggatcgtcgatggggacggctacgcgtccaccatcgtcagagcgctcaatggtggccgaactaactagtgataagttggagaaaaaataggggaatttagaattccgactaatttcactcatggcatcgagatcagcttggtataagaaagcagcatcagggatattattttctacgattgcttgccaagggccagtatcttggaccacgaggaaactcattccggctaaatcgtcgaagtttacggatgtttttttagatagtggattagatttaccaatttctactccaaggtattccacacccaaataaactgattcgatttcatcggtcataatttcttggttggtaaaaattagcttctctttaagatttttaagattatcagcaactttttcaggaaaaacattttgaaaattaattttaactttagcaggggatgaaatttcggagttttctagtaggataactggaccaggagcaactgaaccaattacaatttcatgatttaagtgatggtagtttaatactcgttcagtaaaatcccgctctgctttcaataatttggctgcttctgtagccgcgtaaacaccagtttcatttaatttgatgtggttactaactcggcgatcaaaaagtgatacacctaattcatcttctaatctgcgcattccccgagtaacggtgggttgagtaatcattaaatgctcagcagtcgagcttagtgtaccgtatctttgaaatgctactagctcttttagtaaatcaaggttcattgccaattcgattacttcctttcactattccataaatgcatagtaacatacttgattggtaatttttatatggtaattaacctcctatactagaaagtacttaaagatagtgtaaataaataggatatataaatttaaaggggtacaaagttatggaatatgtaaagttaaatgatggcaaccaaatgcctcaacttggatttggtgttttccaagtttccgatttgagccaagccgaacaagcagtgagcgatgcactcgatacaggttatcgtctaattgatacggccgctgcttatggcaacgaagaggcggtgggtgccgcgatcaagaagagcgggattaatcgcagtgaaatctttgtgacttctaagctttgggtggatcacttcacctatgaaaaagcgcaacaaggaattgaagattcactaaataaattaggattggactatattgatttatacttgcttcaccaaccttatggtgacacagcaggtgcatggcgagctttgattgaagctcaaaaggcgggtaaaattaagtcaatcggtgtatctaattttgctccagatcaattgatgaatctggaattaatgtcagatgttaagccagcacttaatcaaatcgaagtttcaccttggtaccaagaaggcgaagcggttgattttgctcaaagtcaagatgttcaagttgaagcatgggctccctttgcggaaggtaagcataatattttctcaaatgaaacgatcgctgaaattggtcagaaatatggaaaagcgaacggacaagtcatcctacgttggctcctccaacgcggaattgtggtaatccccaagtcagttcataagacacgcatggctgaaaacttagatgtttttgattttgaattgagtgatgatgatatgcaaaagatgagtagtttagataaaaacgaaagtcagttctttgatcaccgtgatccagaagccattgtaagtatttttggtgaaagcttaaaagcattacgtaaataattttaggaggaatttaacagatgaaagcagcagtatttattgaaccaggtaaagttgaagttaaagaagtacctaaaccccaaattgatggtgataaccaggcaattattcggattgtacgggctagtgtttgtggttcagacttatggtggtatcgtggaatttctgaacgtcagacagatacttttatcggacatgaagccattggggttgtggaagaaactagtgcagacgttgataacattcaagttggcgacttcgtggtcgtgccgtttacgcatggatgtggtcattgtgtagcttgtttgaatggttttgaaggagattgtttgaatcgtaaatccggcgataacggtggctaccaggctgaatacatgaagtatgaaccagctaattcaggattggttaaaattccgggtaaaccagaagattataccgatgcgcaattagcttcattccaaactctttctgatgttatggcaactggctatcatgctgcccaaaatgctgaagttaagccgggctcaacagtcgctgtcatcggagatggagccgttggattatgtggagtgatcggggctaagttgcttggagcaagcaagattatccttttgagtcaccatgaagaccgtgctgagttaggtaaggcctttggtgccactgatatcgtagatacacgtggcgatgaagctatccaagatgttttgaagttaacgaaggaaaatgccggagcggacgcaattttagaatgtgtgggtgctactagtgcaatcgaacaagcaggtcaaattgctcgcccaggcgccgtaattggaagagtaggggttcctcaatcagaacctaaatctaaccaattattctggaagaacgtgggtcttcgtggcgggattgcttcagttacaaaacctgataaagaagttcttttgcaagctgttttagatggtgaaatcaaccctggtcaagtctttacaaagagttttgatctagatcatatagaagatgcatacgaggcaatgagtaatcgtcaagctatcaaagcattgctggtaatttcagataaataaaagcatttctatagcttgcttaacattgttagctcaaaaggtgattatacaaagttcaatagaacggtggaaagagcttctagttggtagctctcgtttctgaaataacgcctacaattaactacattatccaagtggaaatgatatttggtttcgttaatatctctagtcaatttcagtattggagtaagagtgttcaattttgatttagatgatgttttaatacttgaaactgctaaaatcccacatcgactaaatctatttaccaaaagtggtaaatatgaattttacggaaggctccaagactacgaaaagaaatacaccgagctttttcgttgttccagatcagctttaattaatataaaaaatatatcggaatacaatgcttcaacaaagatgatttattttgattcatcactaagctgcaagtgttcaataaccaagacacgagaactaaaacgacgtatactagcttacaaataagagaaaaaatttttcttaagttgttcaaatgagaattcataattatacaaaattgattaatgtagtataaaaaggaatccattactcactcagtgatggattcctttttatactttgtaccttgtttccacgaaattagcaggtactatatataattttgctattattcctgatttattttgctaattattttatgaagttgtttatattggctaagcatccatgatttataagtttttcccttgggcagggtttctgtgacagggagtataggaatatcatttttctttgctaacttgaccaaattattaactacctttgaatctacctgtttattgaaaacgaatagcgaaatatcatgttctttaatatttttttgtaactttttaatagtagctggagatgggtcgacaccgttttctatatccttttcaaaatcagcatccgctactgtaaatccaacagcttttaaggcataatcgaaaactggttcactcacgtaagcatttttattcttagtattattagtaatttttttgatacttttgatttgctgattaactgaatttaaagacttaatatatttttttgcgttaactttaaaatattttttattttgaggttgtaatttaccaaactgttttgctaaatcgttagcaagatgaggcatagtttgtggattgtaccataaatgtggattgtcaccttctcgtttatttaaaagatcttccccaactttaatataagtagctttatgtgcattttgggctaacttatccatccaaccgtcataaccaactccatttgcgattaatacatcagaattggttacctttttcgctattttagaagttggttcataatcgtgagggtcaacattgggatcattgatggcagatgtcacttttcctttgttaccgaccacagctttcgctacttcaccataaaaatcggtggttgtggtaatttttatttttccatctttagtagacgaattattttgagaacagccagccattagtattaaggtactggtaaaagcgaatactagcgttacaaattttattaattttttcatatctactcctaaatataataatgtatgccaaataaatctataaaagtactatcttttattagtcctattttttttaatttctttaataatttttagagctcttcttttagttttgacgttagggctttttaagtacctataagcacttgattgattttctttcttcatgtttttctccttaataaagtgatctatggtcaactgctttatgtatttctgaaatttgcatcaaaagcatatttatgaaaattcaaaataaatactaaaagacttatacaacttatgcgtaattcttcatatcgctaaataaatgataaaaatttacattattagatcacctcctaatctaaatagtaatcattactatttagattaggatattaacatttaattgtcaaatttttttgctaattgtggctacatttattaaacaactacaaacttagaactttgagaggatcacagtgtcagaaattactaaaataactaatatataagctttttatgggagtttttgatttaatggtgatttaaatttttctataattcttatttttggcttaaatctaacggcataagtacttcattagtcctcctcgacatgtacgaacgtacgttctataattaaagtgttcttaacatgcgaaagaaaaaaagacctttgacatagcaacattaaaaatatttttctacatcgtaaaaaatgtttttaaaaagtagcttttgtttcaaaagttaataagggagtagtttacatggaaaaaaatttgtcggaacacagtgaaaaatcggtacgtttttttgatttaatgatggagggtttaaaagaccacgttgatgccgaaactttttgggatgcagtggatgaaaacgcagtatttaagtttaattactattttcctaatttgccaaaggaaatgggcaaattaaaatataaagagtggcttgaagagaatactaattcaggatcttccgctgagtttattaatttgtataaggatctctcaacacctggtcaaacgactattatcatgcaatacgttgtgcgctttaaaccaggtatacctgatatgaatttcttgtcaattgctactgttaaggataataaagtagttgcgtgggatgattatctggatacttcaaaataggtagaattaaaattaatttcgtaataattaagataaaataaaaagagcatcactactaaaacgcggtggtgttctttttggatgattatttctagtttaaaactaataacataagtgccccatcataatatttatggtcaattttaaaaaaattttcatatagtccatattctttaaatccaaattttttatataaatgaattgcaggtatattatctgttctaacttctaactctaaaatttctaagttaatagactttgcataatttattatttctgctagtaacatgctgccgatgccttgaccactaaattcttttaagactgatatgccaaaggtccctctatgactaattcgctttcttaaaaatgatttcatgttagctgtacctattattttttcatctttagtagctaacaaaaaaagattttcggaggacttggatgattcttctaaaagatttatctcatcagtaagcttcttttgagccatttcttctggtgttaacaatagattattggtttcattagtaataaattttaaataattcagtacatcttgagcatcttcagattgcgcttctctaataatcacctttgtagaagtcatttcatttcccttatttctttttaaatattatatacccgtttcattttttgcgttacatgatatttatactcttttgcgaacctgatttgtatagtaaaaattgaaataaattctactaataaaaatagaacagttctgaccagaaataaggcatgaataagcagtataattgagataaagcaatatagatatcatgattgaattacattgaggggaatgataaatcaatatgagaaaattgagtcataaacaaagcttgatggtgattattgcgattgcacttttggcggtaatcttacaattcgtcttgggtcaagcttggttagcccaaattctggtttccttggtgggagccgtgatggcgatgaccatgtttattgagatgattgggactttgagatcgggtaaatatggggtcgatttattagctattttagcggtggtttcgagccttttatttagtgagtactgggcagccatggtgattttagttatgttaactggtggggatgccttagaagactatgcttccaagaaagccaatactgaactcaaagcccttttagataattcaccgcaagtggctcatcggctccatggtgaaaaactagaagatattgctgttaatcaagtacaagtagatgataagttggtgattaaacctggggaattagttccggttgatgggtttatcgttgaaggaagttcaaactttgatgaatcttctttaacaggagaatcacagccagtaaataaggactttaacgatgaactcatgtctggttcagtcaatggtgatgctgtggtaaccatgcaagctagtcaggtggccgccaatagtaagtatcaacaattaattaagttggttaagaaagccgaagcaaccccggcccgttttgtgcggatggcagaccgttatgcggtaccttttaccatcgtggcaatcgcgattgcggtggtggccgcggtaatttctaagagtcctagccgaatcgcgcaagttttggtggtggcttcgccttgtcctttaatcttagcggctccggtagcgatggtttcagggatgagtcgggcttctcgcaatgggatcgtggttaagacgggggatgttttagaaaaattatctacggctaaaacggtcgcctttgataagactggaacattaactaatgggcatttgatggtggcggagattttgccacatcaagaagtttcccaaacagaattgctccaaatcgctgctagtgtggaaactatctcctcgcatgtattggcgcgctccttagtaacttacgcgatagataaaggtctggaaatgttaagtgttagtgacgctcaggaaattacggcgaatggagtacaggccttgattcaaggaaaattagtcaaggttggtaagcgtaaatttgtaacgggagatcctttaatcccgagtcaaacccataccgctatctatgtcagtcgggatgatcaatacttaggttgcatcacgtttaccgactacctcagaccagaagctagccagaccatggttcagttgcatcacttaggcgttaagaaattaatgatgttaagtggtgaccaagtcaaaacagctcaaaaaatcggtcaggaagttggaattgatgatgtccaagctgaattgctaccagaagataaaattgctgcattaaaagctctcactccggaagaaaaaccggtagtgatggtcggggacggtgttaacgacgctcctagcttggtaactgccgatgtaggaattgccatgggagctcatggatcgtctgctgccagtgaatcggcggatttggttatcttaaaagatgacctagctaaggtagctaaagcagttgtaatcgcaaaagataccatccgagttgctcggcaagccgttttaatcgggatttttatctgtacagcgttaatgttgatcgccgcttttggaattattccggcatttattggagcgatgttccaagaagtgattgatacagtttcaattttatgggcgttgagggcacgttattctaatgaaaaataagataagttataagaagtaggaaagtatactattttcgaacctatagagagcactttaatacccgagtcgttaaagcataatccaagcatttaaatatattctacactatcctgtataataatctttgtatattaacatctgctttaaatttttttgtcggcatgaatgtagcactaaggatgaggatatgtccttttttgcgcaaaaaaagtgttgatagacaattttattatccagcaacactagttattgtagaactcttttttgcgtatatcatttataattaaacaattaatttcagtctgacgaattcaatattctacgtcttcttattcataataaatactatgtgagttgattttttaatacttgaaataaaagtagctctttttagttctttaaccattatcttgcaatagcggcttaacaaacgctgaaaaaagaatatacccaacaatgactccgcaagcattagtgatgacatcagtaatatcaacggttctttgaatgttgatcaatacgtcgagtactaactgcatcccttcattgaacaagccggtcattccagccgctatcactacgaggaaccaattcagatgtttatggaaaaggattcctagataaactcctgctggaatcgtcatcacgatgttcatgaatgaacccatcgaacgtaaggctgacggaatgtaaatgattttagcatggtgccaatagaagtagcgcacatcatagtagtaggggtcgatgaaatatcgtcctggtgtaaacaataaccatgccacacatactagataaattgctagacttccatatacaatcgctcttttaacacttggacgtcgctcaaatgccactaaacaaccaatcacgatcaacagggagagaccgagaaacggtagatatttaattacgaacataagtagtctcctccttaaagatttaccatctatcttatgatgatttgcgcttggttacaaggtaaaccggaattcctaataaagttataactattccggtggtagccaatattggttggtcaataatcgtcgtgactaagacgaaaattccacccagaatggcaaccactggtaaaaatggatagagggggactttatatggtcgcactaaatctggttgcgtgcgacgtagcttaatgaccgcatagaaaatcaaaacgttaaagatccacatgacaaagattaacatgtcggtcaacaggtcaaaggaaccaacaatcatcattagtccagcgattactaattggacgattccagccacgtaagggaccgctgtgcgtgataatttacttagatgattactcattggcagagaatcttctttagccatggcgtaggggatgcgcattccggtcatcgtataaccattcaaagctccataaacggagatcaagattccaatggtcactagttttccaccgatgttaccaaagagctgtcccgcagcggtagaagctgcattcagattgcccgctaaatcgctgatcgggagggtcttcaaaaagactagattaatgccaagatagacgatcatgatgccagttagtcccaaaccaatggcaaggggcaagtctcgtttaggattcttcatttctccagcaattgcgccaattcctaaccaaccatcataggcaaaaagggttgatagcaatccgccactaaaaccggttaaagtttgagaagtcgtaaaatgttccggaatcaagctaagatggacattgcttggagcaaaaagcccgaaggcaataatcaccgcaatcggaattaacttggcaatcaaggccaccgattggagacgtgcaccgtgcttggtacctagtaaattaattcccgtaattgatgccccacagatgaccgcaattggtaagattagcccagctttcaaatgaaagaggttggtaaattgcgttccaaaaataatggaaagggcagcaatgttagcggggaagtaaattaaggtctgcgcccagcctaatagaaaaccggttagtttcccataagtgacttcgaggtatttaatggcaccaccggtaaccggaatcgccgaagctaattcggcactggtcagtccggcacaaatcgttagtagaccaccagctagccaagctaacaggcttagccccgcggattgcgtgctagctgttacactagaaaccttgaaaaagactcccgctccaatcaccgtccccatcacggtcgaaaaggctgcaaagagcccgatgttcttttgcaggtgagtatgttcgtttttattcataaattctttcctctgtatgctttaagacttattttactattataaataattttgctcaggagtggtaattatctaacaaataaatcacccttctagctggaaggtgattttaatatttagcgatcatggcttgtagttgctttaagtagctgttcttgagctgttcgggtgcttcaatcgtcaggtgtttaccaaaggaaactaggtagtgggtcatataggccagttcggcttgattgtagccacctacgatgtaaggcacaccatcaatcatttctaagtgcatgttggggtaactgtgttttaagaaaagctctttaccaaagggcgttaaccggcatttgaatggaatgttatggtaggtactttcatactggtcttgtaaagctttgagttccgccagcgttaaggtaggggccttagtcggatttatttttaaatcatgcatataatcacaccggtaagtaccccaacgctgggtgtctggattatacgcactcgtaaaccaaattccattacgatagaagagttcatagatttggagctgaatgtggacgtcctcatattgcgtgtaatgaatttggatgacttgttcttctaagatggcattcagaatgatttcaaggttggcgatgtcaccaacgggagccacgttatgatagtggacgaccgcaagcaggttggaaatatcctgctgattttccggaaacattgtcgcaaatagtttttgttgaatccgagcataagattcgtcaaaaggggtgacagaaagtactcgcaaagccttcaaggcaaagaagatggcttggacttccttcttattaaaataaattgggatgaggttggattgattcaataagcgataacctccattgcgtcccggttcggtatagtaggctaggcccatcgcttctaattcttgaatatcgcgtaaggccgtgcgtttagatatgtcaaattcagtgatgagatcctttagttgaaaggaatacttgtctctgagaaagattaattcttggtttaaacgttctgattttttcaattgctaatctcctatttaaaaggtgccatgttttggcgcctttttattatatactcgttttaacgaagtgaaaagggagattttaaagatgaaaacattgattattaacacccatccaaattttactaacgaggaacattactccattaaactccagaaattatttatggagaaattccaggagcattttactgctgaacaactaacacttttaaacctttatgatatcgaggtccctcgtattgaaaaaggccaactcatggatgtttggcaaaaacaaattgcaagagagccactatcagctacggaacaagcagttgccgatcaatcagcgcacttactggctcaattcaaggaacatcaccggattgtaattgtggcaccactccataactttaatgtcacatcccgcatgaaagactacatggataatattatgattgcccgagaaacctttaaatacaccgaagacggatccgtgggattgatgaccgatgattatcgggtgctattactccaagctagtggctccatctatacaaaccatgatcgttatacgcctttggaattttctcatttctatctccaaaaaatgtttgaagaaatcatgggctttgaccaattttcaattgtgcgggcccaaggaacgtccgtcattactcctcaagccgtttgggccaatgttccagccgatatgcaaaaagcttttgatcaattctacgctgactaactagtaataggctaccgagttaaatcgattcgaatattggattagattagagtacaatattcaaaaaggaggtagcccatggagcgtaaaagacatgctaagtatcggcctaaatttaatatgcgatttgtccatcaccgtcgacgaataattttaggagcttttctgctcgtggtgctactagccatggctggcgtctgggtagttaaaaaccaacaacgcggggcgcggttggcgctagcgccgtatcctgttcatggctgtgtgattgatcaggaaaatggcattatcgattttaattccttacaaaagcagcacatttcatttgtgtatctcaatgcgacgaccggggcgacttactttgacgatagttttaatacaaattatagtcgaattcaatcgactgatcttaaagttggtattgtgcataactttagtttccaaaagcgtcccaaagcccaactgcgttttattagtcaaaaggtcaagagtaatacgggacagctgcccgtggtgattcgagtcagttactatggggattatgatgctaagcgggttgattggaaaaaggcaggtccaaatttagctgacttggttaaattgctagctaattactatggacaggcggttgtgattaagacgacgcctgccattaaacgacaactggatcctacttacattaaacaaagtaagttttggctagaagaaccccagattaaaaagcacaatcggcgggttcaatttgtcgaatacgatgcggaacaaaaatttaaaaataatcatagtgatttggaacttcccgtctcctattttaatggttcacaaaagacttggaatgaacagactaactaaaaagagttgtaggtaaccgaacggggttactcacaactctttattttttttagattcaataatggcataggtttcgttattcgcttcgtcataaatgctgatgggacgataatcattcgctttaattattaaatgatagccaaaacggtcgataaaggtaattccataatcatctagagcttccacgacggtcttgagcaatttgccatccaaatagacatcatagttaggacggatgtctaattcatgctcccaattagtagtttgatcgtgatacaaccatgtcccagcaaagaaaaatggactcacgcctttaggatccttagccggtttttttgaatcaagtccaatgaatgaaaatagttcaccgaacgcatttttttgccagttcatcgcttcaactccctctctcaattttccgtttaaatataccattaattaaaccggggaagtagtgaaaagactctgtttttaggagttgttaataaaatgaattaaagtgaaataattccgtaatactgtagttttaaggtaaaatagaagtatgaaattaaaaggaggaactaccatgattaaatttggaattattggtactaattggattacacaacaatacgttgacgctgctcacgctaccaacgaatggaagctagttggggtatattcacggaccattgaaaaagcaaaatcatttggtgaaaagaatggtgctactaagttctatgatcagattgaagacttagctaacgaccccgaaattgatgccgtttacattgcttcgccaaacagtttgcattttcaacaagcccaacaagtcttggcagcggacaaagctgcggtagtagaaaagccaatcgtcgctaatccaacggaatgggaagaactctatcaaactctagaagcccatccaaaagctcgtttatttgaagcggctcggcacttacatgaacctaatttccaagccattcaaaaacaagtcggtgagttggaattaatccaaggtgctacgttaacctatgctaaatattccagccgttatgatagctacctcgctggcaacgaaccaaacattttctcattgaaatttgctggtggagctctccaagacttaggtgtttaccttgcgtacgatgcagtagcttggtttgggatgccggaagaagtggcttacttcgcccagaagttgcggacaggagctgatggtaagggcgttgccatcctacgctatcccgaatttgatgtaactttaaatattgggaagaacgttaattcagaacttgcgtctgaaatctatggcgttaaggacagcatcgtcatggataatgcggctgagctcaatcaagttgaatatattgacgctcaaggtcaacgaacggtgattagtgaaacaccagatgacaatccaatgattgcagaagcacgtgactttgcacgcgttattaatgatccggaaaatgaaaaaaacgccaccgattatcaaaattggctagaaataagtcgaaatgtaaataaactactatataatctccgtcaaaatggtaagatatattttaccaatgaaaaagaagaggactaaacattaatgaatgatttatttaaaaagcattttaacgaaaagggttttgcagaaccgactttgattcaacaaaaagtcgctgaaccccttcgaaatggggaatcggtgctcgggctatcacccactggttcgggaaagaccctcgcatttgccttgccgttgatggaaaaaatcacgcctggcgatggaactaaattattagtactatctccatcacaagaacttgccattcagacgacggatgttttccgcgaatgggcagctttgattggacttcgggtcacttcgattacagggggtgccaacgtccaacgtcaaatcgaacgcttgaagaagaaaccggaaatcgtggtcggtactcctggtcgagttttaacgttgatcaacgaacgtcgcttaaaagtgagtgaaattcaaagcttggtcattgatgaagccgatgaactcctaactggtgaaaaccttgaaggaacccgccaaattgaagatcaactcctagctgatgtgcaattaagtttcttctccgctactaacgatttagcgctagatgatttggaagcttggtttgatgtgcatccacaagtggtagacgtccgtgctgaagacaacactcgcggtcacgttcaacatggttggattgaagtgcctgaaaagatgaaagcacgtattttaaaacgacttagtcgagttaaaaacttccaaggtctggtcttttttaaccacgtttcgacgatggaaaagacagcggctttattgaagcatgaaggcgtagatgtcggcaaaattgcgggacatcaagtccaaattgatcgtgcagcagccatgcgacgttttaagaaaaaggaattgtcactattaatggtaactgatgtagcggctcgaggcttagacatcgatcgtttaccagcggtgattaactacgatattcctcacaacgctactacctatacgcatcgcgtggggcggactggtcggatggggcaagatgggtatgtcatcagtctgggaaatgatcatgatattcgggacttacgaaagatgataaaggaattgggaattgaggctgaaaaattagccatccaaaaccggaaaattattttggctagtgaatacgttgaagcacctaaagcaccatcgatcaaggctacttcaaccaaaaaatcagctcctgaacaaaaatcacaagctggagctaagactcctaaaaactctaaagcaaagagtcaaaagcaatttgataaccctcccgcaacccccaagaagaagggtaaaaagaaacattctaagcgtaaaggaatgcggcgcgttaagaaagagttataaatttattgaattttggttaattatattttttatagttaaaaaaaggcttaaatagtgtaatatagtcactgttgaaaggtgggtatatttttatgcgtagagaacatacaaaaaaatcgcatactgtgcgaaacacgattttaatcgttctggcagttattttacttggaggaggggtctacggttttcggaagtatcaaaatgtgaaaaatgccgtggataatacctatagtagtgcaggaattaaaaaacaacgtaatacaaatagtttgttaaatggtaagaagcccatttcgattttattaatgggaactgacacgggggctttaggtcgttcatataaaggacggacggatagtatgatggtggtaaccattaatccgaagactaaaaagaccacgattactagtattccgcgtgatttaggtgttactattccaggttatgaatcgaagtcaccttctaagatcaatgctgcttacgcctttggtcaagctggaacggcgattaaaactgtccaacaagtgttcaacgttccgattgatttctatgttttagttaacatgggcggtatggaaaaagttgttgacgaagctggtggagtagatatcacgccaactttgagctttacgtatgatggatatacctttactaaaggggttaaaacccatatgaacgggaagaaagccttggcttattcaagaatgcgctacgatgatcctcaaaatgactatggacgtcagactagacaacgagcagtgttaactgctatcatcagcaagagcagttctgtatcaagcttattaaacaaagattttattgattcaatttctaatgaaactaagaccgactttacctttaacgatctagtcgacttggctaaaaactatcgttcatcaaccggtagcattgaagaaacccatgctcaaggggatggacagatggctaatggtcaatccatggaaattgtttcaaacaccgaattacaacgggtaactaactttattcgcaatggattaagtttagaacacgaaaagacgggcaccgcagccttgtcaacaagcagtgctaacactagtgatagtagtgtggaagcagctaatatcaatgcaggaaattaaggaaaactaaggagatagaatcatggcagcagagtcagaagcagtaaaagaagaaaaaaaaacatttgatgttggtgacgaagttaccgtagcaaagaccgatttactaccaactggtttcgaaggaaccgttggtaaagtttatgaaaactcaattttaattgaaattgatccaaacagcgtttctaacccacgctcggaggagttgcatgaccttcacgggcgggtagtcgttcggatgagtgaagctaagaaaaaatagggttaggaaaactctaaaatttggcgtaacttaaccgccaattttagagttttttgttaagatgtattatttttgtaagcaaaaaagggttgtttatgataaaatacatgaagttagattgtgtacaataaaaatactacattaaagacgtataaggaattatctgtacattattaagtttatctaaacttaacgatgtatgaggcttttgataagtattttatagttgcttttgctattataaatattgtaagcatatccaacggtatattgtaatattattgatagagaaaaggggaatgacaatgtcaaaaaagattgatcttaactctgatgaactgattggcagtcgcgaagctagcttgatgtggggcaagcaaaaggattatgttcgcacaatttataacaaatatccaaagcgctttccggaaggcaccatccgtaagttcggtaagcagttagttgtaactcgtgatggtatggaaaaagtcacaggagttaaatacgaagaactaaaagaagaagacatcaacaaagctaaagaaaacaaataattttttgacttagagtacaggtagctggatttgacttctaatttagaggtcgacgccgactacatcgatagaaattaggaaattcttttttacagtcctaaccgaaaagccatttgatccaatgttgttgggctagatggctttttggtttaatttgatataaaaaatcactcaatctaattaagattgggtgattttttgttttggttcgcatatgattaacgaatcccagtattatcaacacttctgtctgtattcaaatgtccccggcgagaatcgaactcgcaacctatcgcttaggaggcgattgctctatccagttgagccacggagacttaactagtttattttcgcacgattttttaacgatgtaaagcagtggatgagcctttttataacgttttatgggttatctttcgttaaaattgaattgatacggtctttttaggactttgattgtgctgatacaaagaagaaaacgaacattaaacgcttgttttatatttaaagttagtgtatattattttgtggtgacaaaagtacaccaaatttatgcacttcgaggggacaaaaatgaaagtatttgactatgaagacatccaattaattccagcaaaatgtatcgtccgtagtagaaccgaatgtgatcctacagtggtcttgggagaacatcgttttaaactacccgtggttccagctaatatgcaaactatcatcaatgaagagattgctgaaaagttagctgaggatggatacttctacattatgcatcgttttgaacctgaaagaagaatggactttgttaaaaagatgaaagacaaaggcttgatcagttcaattagtgttggggttaaagacgatgaatatgcactaattgatcaacttgctgaagaaaatcttactcccgattacattaccatcgacgtggctcatggtcatgctcaaagtgtaatcgacatgatccactacattaaagaaaaattaccagctgccttcgtgattgcaggaaacgttggaacaccagaaggagtccgtgaactggaaaatgctggtgccgatgcaactaaagtcggaattggacctggtaaagtatgtattactaagattaagaccggttttggaactggtggttggcaattatcagctctccgttggtgtgccaaagtggctcgtaagccattaatcgctgatggaggaatccgaactcatggtgatattgctaaatcaattcgatttggtgcaactatggtgatgattggttcattatttgccggacatatcgaatcaccaggtgaaactaaggtggaagatggcgtgaagtataaagaatacttcggtagtgcttcgcaataccaaaagggtgaagctaaaaacgttgaaggtaagaagatttggatccatcaacgtggacatttacgtgatacactccaagcaatgcgtgaagatctccaatcatcgatttcctatgcgggcggtagagatttggaagccatccgtaaggtcgattatgtgattgtgaagaattcgatttttaatggtgatgtattgtaaaaaaagagtgtggatgaaaccgggctgactttgaggattgacatgatatcgacataaatctgggttagggatttgtgtcgatattaggttaaccggagaggttaggtttcaggaacaggtttcaaataaaaaaagagtgtgaacgaaaccgggctaggtttcgaaaatacatttccaatacccaaacctaaaaaataactcaacttaagcgcaaatctgaactaaaggtttgcgcttatactgggttaaccagaaaaaaaggcatcaatcgtaatttgcgaccgatacctttttttaattaattattattatttagcccagttaccatttcggaaaaccggaacgatgctaccgtcgggtttaattccatcaatgtgcatttgatccgagccaaccatgaaatcaacgtgggtctgactgatattcatgccatgacgttgtaattcatctggagtcatcgaacttccgttttcgatggtaaatggataagcttctcccaacgccatgtggtcagaagcattttcatcaaaaagggtgttgaagaaaattgtatttgattgtgagattggtgaatcatcgggaaccaaagagatttcaccgagtgatttcgcaccatcgtcggtttggaggaggtgtaagagtacttcttcaccacgatcagcggcagctttaattaccttaccccgttcaaaagtgaggtgaattccctcaataatcgtgcctccatagcttagcggtttcgtcgaagtgacggtaccgtcgatgtggagattatctggggcagtgaaaacttcctctgtaggaatattagcgacgaaggtgttcccagctgcatcctttgcatcagcggcgacccagatatgacctttaggtaaacctacagtaagatcggttccaggggcctggtaatgcaaggcagcgaaagcttgttgattaagccagtccgcatggtgagcaaggtccgcaattttattttgccaagctgcaaccgggtctgcttgatcgaccagcgtggttttgaagatggcttgccataaagcttggacggcctcattgccctttaattctggaaagaccaattcagcccacttaagatcagcggcggccaccaccagccagctaatatcgttgttagtagtgacttgcatgattgggcgcttagctaaaccttgggcagcttggtaagcagcgatgcgtttgctaggaacctcggcgagggcattagggtcatcactaatcaaactgatgcgcgacacgcgttggtcggctaagaattgccatttatctttttcgtaatcaaaaacttgaccaatccgtgcttcagacgcatgcattaagaattggcgagtagtttcaatatcgctccattctaaaattacgtctgcggctcctaaagcataggcttcggcggtaatcaggttggctagatgtttttgcgttacggaagcatataggataatcgtttgtccttcttgaacattcacaccaacacgggtgattaattgggcatacttctttaaatttttttcaagttcgctgtcattcatactgggaaaacctccttatttttttactatcctagcatattttatgcaggaatgctgatataatattcttagaagttgaagggtggctataaaatgaagcagattaaagtaacgagtatctttggcacacgaccagaagccattaagatggcaccagtggttaaggccatgaaaaatgacgaccggtttgaacccatcacggtggtgactggccagcaccgtgaaatgctcgaccaagttttacaaattttccagattaaaccagattatgatttgaacatcatggaaaagagtcaaactttgagtagcattacaagtaaggtcttatctggcatggacgaaattttaaatcacgatcgcccggatttaattttggtacatggagatacgacgacaactttctcagcaggcttgagtgctttttatcaccaaatccctgttggacacgttgaggctggtttacggacttggaataagtattccccatttccagaagaaatgaatcgccaaatgaccgatgtgctaacagatctttattttgctccaaccacaaccagtgaagcaaacttgcttcaggaaaatcatccacaaaaacaaatttttgtgactggtaatacggcgattgatgccttacatgatacggtccaaaaagattaccaaaatgaggttcttgatgaaatcaaggccgaacatcggattatcttagttaccatgcatcgccgtgaaaaccaaggcgttccgatgcaacgagtgtttaaagccatccgccaagtggtcgacgaaactcctgatgtggaagtgattttccctgtccatctcaaccctagggttcaacagatggcagaagaggaattgggcaatgacgctcgaattaaattaattgctcctttagatgtactggacttccataacattgctgctcggagttatttgattatgactgattccggtggagtccaagaagaagccccatccctcggcaaaccagtcctcgtgctccgcgatacgacagaacgtcccgaaggggttgctgccggaactttgaagttagtcggtaccgatccagtagaggttaaaaaacaaatgaccttgttgttgaatgatgcggaggcttacaaccaaatggctcaagctaagaatccgtatggagacgggacagcatcgaaacaaattctagacgccattgctaaatggcaaaaccagtaatcattgtattagttttcgatataataaaggagctgtgactaagctacgataacttgtcggttatctagcagctgtcacagctccctttatattattaataactattgggcgttaaatttatccactaggctacttgcaaaattatccaaacggtctaaatcttcttgggattcaggggcaaggttaattttaagattttccgcaccttgaatggcgtgggctttagtcatggcttcactgaacttatcgaccgctaagcaataatattcagcgtaaaaggtatctccagaaccagctactccaaagactttaccagaaaggtcaagttcagcgaggtcatcaaagaaatccattccttcttctggtagagctccttcatcgtaggtgtaaggaacaatgacgttaatgtcataatcttttagttcggcagcatccgtttgtgaaatttcagtttcatcgacttcaacgccgaggtcttctagggcttcggtgatgatgtcagcgcaatcttcattgttaccagtgatagtggcaaaaactactttagcagtgggcatatttaagtaaccttctttccaattaattcttatcaaagtatagcaaaaaaggagctgattaacattaattcagcagaaactaaaaaaattaccatgattaccgcccagaaaaaggctggtcgctacaatgtttttcttaatggtgaatatgcgtttcccattagtgaagaaacctttatccattttcgtttaagtaaagggatggaaattacgggcgcgctcttagaagagattggtgaatatgagacgagtgcggaagcctacaataaggctttaaatttcttaacgggtcaattgcggacgcaagatgaggtggctaagaaactcctcaagctggatttcccagaagaggttgtcggtcctgtgttagctaagctgactgatttgaacttgctggatgatgccgaatatgccaagagttacgttcggacgatgatgaagacgggggacaagggaccgcgttatctaatcaaccatttgcgtcaaaaaggggtttacgagaatgacatccaaatgggccttgctcttttcactgccgaagaccaagtggagctggcggtccaagtcggcagcaaaattcaaaaacgccaaagtaattccgcccttaaacaacagaaactcaaagttcgacagactttgatgaataagggctttaatttggctacgattgatttagcactccaggaaatcgaatttaaggttgacgaggaggccgaatatgaaaagttagttaagttgggtgaacgtttaattcgaaaacatgcgggtctccctgcctatagtaaaaaagccaaaatcaagcaggctttgtacaacaaaggctttgaaattgacttgattgaacggttcatgcgtgaaaacgagttatagaattctgtagaaaagcttaaagcatggtgcaaatctaaggctggttttgttataattgaagagaaattcaaagctttcagctgtagaaagtgggcttaggctatgtctcagtactcagaaagaccaaaagagggcgagtatattgcgataaaaagctataagcatgatgggagtttgcatcggacttggcgtgagaccatggtcctgaaaaacaacgaagatgagtttattggatgtaatgaccatacggtggtcattgaagatgatggtcgtcgttgggtgaccagggagcctgcgctagtgtattttaataaacatacgtggttcaatgtggtggcgatgattcgagacagtggggtttcgtattattgtaatattgcgtcgccgtttgtgttggatcgcgaagccttaaaatatgtcgattatgatttggacgtaaaggtttttccaaatggcgaacggcgcctacttgatatggacgaatttgaacaattcagtaaaaaatggcgctatcctcaggatacaatcaaaattttattggatagcgttcgcgaattaacgggttggattgatgaaaaacgtgggccattttcggtcgagtttattaatatttggtacaaacgttatctaaatatagcggagcgaaatactcggtaaaaaaggaggtgtgcataacacttcctttttgtgtaaaaaatactaaaattagaatgacgatatcatgcgaggagtacgttatgtttgaaaaatttagaaaaacgccattgatgtattggtctttggagctactaatcgtggcaacgttaatctgggtgtgcacgaagattgatttcctgtttaccccgattgggacgttcattagtaccgtatttatgccaatcattttagccacctttttgtattatatgcttaatcccttggtaaagttgttaactaaggtccgttacaagaaatttaagattccccgcaccttagcaattgtgattgtgtttgtcctatttatcacgttgattgtatggggaattagttctttcttaccgaacttaattgatcaggtttcccaaatgctggggaacttgccttacattgtcaaaaggttgcaaaagaccgtcccacagttgttagaacattcgtggttgaagaagattgacttcgcgccctttatcaaaaatatcaatagtgagattggtaagtatgcggaaggctttttagcagggacggccctgcatatcggtaatctgatttccaccgtaactaatgccacagtggtggtgattaccgtgccaatcatcttgttctatatgctaaaagatggttacaaattgatccccacagttgcccaagtggttccacaccggaatcgtaagaatgtggtggatttatttaataccatgagtgatactttatcttcgtacatttcaggacaagtcattgaatgtttgtttgttgggacgttcacggtcatcggttatatgattatccaacagccctacgggttacttctcggagtgattgcgggaatctgcaatatcatcccttatgtgggtccatattttggaattttcccatctttactagtggcaattgctcaatcaccgggccaagttgtttcagtgattattgtggtattgattgttcaacaggtggacgggaactttatctatcctaatgtgattggtaagtcacttcaaattcacccgttgaccattattattttattgttggtggctggaaagatttctggcattctcggaatgattttagcggtgccagcatatgcgatagttaaagtcttgattaacttcattcatcacatctggaagttagatcaagaaaccattgaagaaaaaattaagcctcaaaaataataataaattggtagatataatggtagtatggtaatatctacagagttagataatataattcaaggagaataaatcttgacaaaagtaattacttacggaacttttgacttattacataaaggtcatatccgtctactcaagcgtgctaaggcactaggagatcatttaaccgtttgtgtttcaactgatgaattcaatgccattaagggcaaaaaagcttatacgtctttcgaagatcgtaagtacattttggaagcgatcaagtatgttgatgaagttattccagaacgtgattgggatcaaaagattagcgatgttaaggaccatgacattgatatctttgtgatgggtgacgactgggaaggtcaatttgattttctaaaagattattgcaaggtcgtctacttgccacgtacggctggtatctcaactactaagatcaaaaaagatcttggactaggcgattacaaaaaagattaggactacaaactaagattgggatgtctagacgattccaatcttattttttagagagaaaggaactactatgaatcaacaagatttaaaaaatgcggtggaaaaacgccggacgtttgccattatttcccatccggatgctggtaagacgacgattacagaacaactattgctcttcggtggcgttgtgcgcgaagccggaacggttaaagcccgtaaatctggcaactacgctaagtctgactggatggaaattgaaaagaaacgtggaatttcggttactagttcggttatgcaatttgattatgctggtaaacgaattaacatcttggatactcctggacatgaggatttctcagaagatacttatcgaaccttgatggccgtggattcagctgtcatggtaattgactccgccaaagggattgagccccaaactaaaaagcttttccaaatttgtaaaatgcgcggtattccaattttcactttcatgaacaagttggatcgggatggacgcgaacccctagacttggttaatgaattggaagaagtcttaggcgtagaagcttatccgatgaactggccgattggaatgggtaagggactagccggattgtacgatatttacaacaaccgcattgaactacatactgatgaaccagaatttttggaactcaacgctgatggcgaactcaaggaaagcaatccgatcgaagaggaaagtgttttccaagacgccatgatggaagtttctttaatgaaagaagccggcaatcaatttgatgaagccaagattgctactggggaattgactcccgtcttctttggttcagctttgactaactttggggttaagactttcttggatgcttacctccaatatgctcctgcaccaacttcacataaagatgaagccggtgaagaaatcgaaccaactgaagaagaattttcaggatttgttttcaagattcaagctaatatgaatcctaatcaccgtgaccggattgcctttttgcgcatttgctctggagaatttgatcgtgggatggacgtcactttgaaccggacgggtaaaactttacgcctttctaattccactcaattcatggcagacacacgtgaaaacgtggaaacagcggttgcgggagatatcatcggactttatgatacgggtaacttccaaattggggatactatttacgctggcaaacatgccattcaatttgaaaaattaccacaatttacaccggaactatttatgcaagtttccgctaaaaacgtgatgaagcaaaagtccttccataagggaatcaagcaattggttcaagaaggagctgtccagctttatactaactacactactggagattatattctcggtgccgtaggtcaacttcaatttgaagttttccaattccggatgcaaaatgaatacaattccgaagtagttatgcaacctatgggtaaaaagactgcgcgctggattgacccagaacaactcgatgaaaaaatgtcgtcttcacgtaacttattggttaaagaccgttatggacaaccattgttcttatttgaaaaccaatttgcagaacgttggtttgctggtaaatacccagatgttaaactaacggccaaactctaaaaactaaatctttctaaattaacacctcaaatggggttaattttttagtttttaatatataatggttaagttgtatcaagaaatatcacgtggaggaacgatagcatgaatcgtttatggggtagatttcgacaggggctaaatactaaatttggcttcttcatgctaattacaggtttattttggattaaatcgtacatagcatatcaaacaaaattcacgctgggtgttcaggatggcatgcaagaattgattctcgccatcagcccgctgggttttgccatacttttgttcgggattggattgtatatccgtggtaagtgggcctactggtacatgattattatggatatcatcttatcgacttggctatttgccaacatcctttattatcgcgagttttcagatttcattacctttaatttaattaagggttctgggtcagcctccgataatctaggaaagagtttgatgggaattctacgaactactgatttcctagtttttattgatgtaattttcgttattgctattttagcgtttggattcgttaagatggatcaaagcaagttcaagttaatgaactcctttgcggtgacggtcctatcgattggggttttagcagctaacttggctttagcttattccaaccgttcaggattattgacgcggacctttgataataactacattgttaagtacctaggactacaaagtttcactttgtatgatggggttaagtcatttgaaaacagcaataagaaaaaggaagctaagggttcacaattagatccgattaagaagttcatcaaagaaaataatgttcctgctaatgttgaatacaaaggggtggctaagggtaaaaatgtcattatcatccatttggaaagtcttcaacaatttgtaattaacaaaaaatggaaaggcgaagaaattacgccgaacattaataagttctacaaggataaaaatactttagcttacgacaacttcttcaatcaagttggtcaaggtaagacggcggatgccgaaatgatgctggaaaattccttatttggtttggcagaaggttcggcgatggtaactgacgggaccaccaatactttccaatcgatgcccgctttaatgcaacaaaatgggtattcgacggccgctttccatggggatgtagctagtttctggaaccgagacaacgcttataagtcatttggttatcaatacttcttcagtaagcaatattacacattgaagaagggctacgttagtggatacgggatgaaggataagctcttcttacaacaatcggctaagtacttggaacaattaccacaaccgttctatgctaaattgattacggtctcgaaccactatccatacggaatcgaaaagaagaacgtttctatcgacaaatgggataccggtgattcaaccgttgatccgtatgtgcaaactgcgcattacttagatcaatcaattggggaattactaaattacttgaagaaaactggtttgtacaataagagcaccatcatgatgtatggtgaccattatgggatttctaacaaccataagccggccattgccaagatcttaggtttgaagggtgtaaccaactatgatcttgcaatgttccaaaaggttcctttcatgattcattcacctggtctaaagggtggtgttaaccacaactacagtggtgaaattgatgtgatgccaaccttattgaatttactcggcatcaagacgccaggcgcttaccaatttggacatgatattaattcaaaacaatacaaccagattgtggcgttccgaaatggggactttgtttcgaagaagtataccaagtacgggggcgacctctacttgacggccactggtgaacaagtcacagacgaaacacctgctcaaaaacaagaagtgaagaagatccaagattacgttaataaagaactcgaatattcagataagattattaatggtgatctcttgcgctttgccaagttggattggtttaagaaggttaataagtcagactacagttacaatatgaagtcggcgctcgaacaactaaataaagctcaaagttctaagacgagtttgattgaacaaaaccacggcaaatcaacgttggatgattatgaaacggatgctcctgaactagaaagcaatgctgataaatcatctagttcaagcagtagttcttcagatagctcagcttcgaagtcttcaagcagtgattcaagtagtagctctagttcatcatctgaaagtagtaagtaacttaaagactgagaagagacctttaggggtgcttctcagtttttttattaagagaggaagcgattttatggcaagtcatttgataattctactattagtgggactaatggccggaatttttggagccatcctgggaattgggggaggaatgattattactccagttttaacggtggcaatgggattagatattaagtatgcgattggggctagtatcattgcggtgattgcaacgagttcgggggcaaccattgcgtatttaaaagatgagatgcttaatttacgagtagcgatgtttttagaaattgcgacgaccgtcggggcgattgttggggcaattatgaccggaatatttaactcgaccgtcctttttgtgctttttggttctttcttggtattttcttcttggaatatgtaccgcaagttgcgtcgcggcggtggtgaagaaggtagtactaaaaatgatcgtttagcaaatcaactcaacttaaatggtagctactatgataaagctcttaagaaaaatgttgattaccaagtagaaaatgttcccggtggttcagccgtaatgtttggggccggattagccagtggattattaggaattggtagtggagctttcaaagttatggcaatggataacattatgaagatgccacttaagccttctagtgctaccagtaacttgatgatgggagtcaccgctgctgccagtgccatggtctatttctttaatggttccattcatgctgatattgcaggaccattagcgattggaattttatttggagctcaattgggaagtcggattatgcaacacctacaaccccgttggattcgaatgatttttattcccgttcttttatatatgggattgcaaatgattctaaaaggatttggggtgaacatctaatgaatgctaaaaaacaagagatgcaacacgtggaattagtcattgggcgtgtccttcaagtgggagtatatatttcagcgctagtgattctattaggaattggtctatggttatttaagaatggttctggatattcgggggctttaccaactcggattacgcctatctttcatggggtgttagcttttaaaccttatgcggttttgatgtttggaattttcttattaattttgacacccgttttacgagtaattgtttcaatttatgcctttgctaaagaaggcgaccgtttgtacgtggtcattactacaattgtactagtaattctaattattggtatggcaattggttatcgcggataaaaaaagaagaggttaggtaaaccataattggtttatctaacctcttcttattatttaatcttttttaggagcaccagtaatttcaatttgatcatctttaatcttagcgtttagttgcttttctgctggatggtcaagatagaagtccgcgatgcgatcttcaatttgttcttgaattacccgacgcaatggacgagcacccatcttaggattgtagcctaaatcaactaagcgttcttcaactggtttggttacatcaacgtgtagtccttgggttgccaacatgctattaacgtctgcaatcattaagtcgacaatttgcattaagttttccttagttagggcttggaactcaacaatgtcgtcaaaacggttcaagaattcaggcttgaagtaatttcccagtttgtcaaggacagagtgggtcttaccttgagcagctgctccaaaaccaacatcagcttgtacgtcaccagttccggcattagaagtcataataatgatggtatctttgaagcttactgtccgaccttgtgaatcagttagacgaccatcatccaagatttgcaagaacatatgcatgacatctgggtgagctttttccacttcatctaggagaactaagctgtatggatgatgacgaacttgttcagttaattgacccgcttcttcgtaaccaacgtaccctggaggcgaaccgattagttttgatattgaatgaggctccatgtactcactcatatcaaagcgaatcatggaatctttagaaccaaacaattgttgcgcaagttgcttagctaactcagtcttaccaactccggtaggaccgacaaagaggaaggaaccaatcgggcgaccagttccgtttaaaccaatgcggttacgacgaatggcacgagaaatcttattgacagcttcatcttgtccaatgacgtggtctttcaagttttctgaaagattttgaagttgttcttgttcctgcttttgcaagtcaccaactggaatgtcagtcttagtttcgataatcttttccatatcttcttcagtgaccgttggttgttcttcgctacttgttgcaccatctttgtttttttcaagcttagaaacttgatcacggtagtaagctgctttttcgtaatcttccgattgaagggcagctttcttttgagcttccgcttcatcaatcttcttttgaatggtttctggatcagcgatgttaatcgttagattcttcttagaaccagcttcatcaaggaggtcgatggccttatcaggaaggaagcgatcttgaatgtagcgttttgataattttacggctgcttcgattgcatcatccgtgtagtgaacatgatgataatcttcgtatttcttttgaattccttttagaatcttaatagcttcttcttcactaggttcatcgacttgcactggttgtaaacgacgggcaagggccgcatccttttcaatgtctcggaattctttaagcgttgtagcaccgactaattggaagtcgcctcgggcaagggctggtttaagaacgttaccagcatccatgccgccttcagcattaccagccccaacaatttcatggatttcatcgatgaagacgaccatgtctttgttagcttgaacttctttcattagttgttgcatgcgttgttcgaattgaccacgaattccagtaccttgaactagagaaactacgtccaaacgcacgatttgtttattaactagcttttgaggaacagaaccttccacaatccgctgagccaatccttctacgacagcagttttaccaaccccagcttccccaattaaaactgggttatttttagtacgacgatttagaatttcgatgacccgttcaatttcgctgtcacgaccgattacgggatcaatcttaccttgtttagctaaatcagttaggttcaagccatactgacttaaaagtgatccgccgttgccacggttgttaggattaccacctgaaccatttccaccacctggttgagtagggggaacttgttgtccatagaggttttcgggttgtcccatattgccgccttgcatcgcacggaagatgtcatctaagtttccaaatccaaatggatcttgtgccatacgagcacctccgtttctattaatgttattatttcgttgattttttaaaagttgatagcaattctgacacagattaacttctgtacgttgaccattcacgttcgtatagaggtgaatgcttgcttcgttcttttgacagttttgacaaagcatctgctgtctcccttctttcaaaaatatgaaacgataattagtcaaataacgtttgactaatattgaccatacccaaattatacacactctatttcagagtgcaagtagtttgatttgaaaaaaagatggataatcaggtaatattattgttgataacaaagtacttaatggtatagaataaatagaccgaagtgaggtgacaacatgcgagattatttacagcttttgaatgatttaaaggatggttcaatcaaagagctaaagattactgcagaggagttccaagatttccagccacgtttcatggaatttcctgaaagaaagcaagtaattggaaaagcagaccgtggcggggttgttgtttatcactttgagcgtatcaaagataaataacggatttatttaagttttatgtaagggcttgctttgcaactaataaattgatatgattcttatcaaaggcttataaataattagtgtacgttcactacttatttgggtcaaaaatatatgtgtaatcaaaaggagatattttattatggaaaaacgcgactttcatgtaattgcagaaacaggtattcatgcacgtccagcaacattgttggtacaatcagctagcaaattcaactcagacattcaattaacttacaaagacaaatcagttaacttgaagtcaatcatgggtgttatgtcacttggtgttggccaaggcgcagacgttactatctcagctgatggtgatgacgaagcagacgcaatcgcagcacttgaagatacaatgaaaaaggaaggactatctgactaatggctggcacattaaaaggtattgcggccagtgatgggattgccattgctaaagcatatttgatggtggatccagatctttcttttgaaaagaaaaacattactgacgttgatgcagaaatcaaacgccttcatgatgctttggaaaagtctaaagaagaactttcactcatcaaagctaaggctgcagaaaaccttggtgctgaagaggcagaagttttcgaagctcatttaaccattctttctgatccagaattgattggtaatattgaagacaaaattaaaaacgacacaattaatgcagaagaagctactaaggaagttacggataactttatttcaatgtttgaagcaatgactgacaatgcttatatgcaagaacgtgccgcagatattcgtgacgttactaaacgtttgatgagtcacttgttgggtgtggaacttcctaaccccgctttgattgattcagaagtcgttattgttgcgcacgacttgactccaagtgatacagctcaattggatcgtcgttacgttaaaggctttattacagatattggtggtcgtacatcacattctgcaattatgtctcgtacccttgaaattccagcagttgttggttctgaaaaggctactactagcgtaaaacaaggcgaaatgatgattgttgatggacttacaggggatgcaattattgcacctactgatgacgaaatcaaagcttatcaacaaaagggtgaagaatttaaggctcaaaaagccgaatgggaaaaacttaagaatgaaaagaccgtttcaaaagacggtgttcattttgacttagctgctaatatcggtacaccagatgatttacaaggtgttcttgacaatggcggtgaagccgttggtttgttccgttctgaattcttatacatgaatgcttccgaattaccatcagaagatgaacaattcgaagcttataagaaggttgttgaaggcatgaacggcaagcaagttgttgttcgtacaatggatattggtggagacaaggaacttccttacttaccacttccagaagaaatgaacccattcttgggttaccgtgcaatccgaattagtttggatcgtacagatttattccgtacacaacttcgtgctttgctccgtgcttcagcatacggtaagctagcaattatgttcccaatgattgctacggtagccgaatttaagaaggcccgtgctatctatgatgacgaacgtcaaaagatggtcgatgctggacaagaagttggtgaaatccaagtcggtatgatgatggaaatcccagctgctgctatgattgctgataagttggctaagtatgtagacttctttagtattggaacaaacgatttgattcaatactcattcgctgctgatcgtggtaacgaaaaggtttcatacttgtatcaaccatataacccatcattgcttcgcttaatcaagcaaactattgatgcttcacatgctgaaggcaagtggactggtatgtgtggtgaaatggccggcgatcaaatcgctgttccaattttaatgggacttggtttagacgaattctcaatgagtgcaacttcaatcttgaagacccgttcattgatgaagaagttaacaactgacgatatgaagaagttagctgaaaaggctgttacagaagctgaaactaacgaagatgtaatcaagttagttcaagaaactgttgacaacatttaatctaaagcaaactattttagaaccgctgaccttagtgtcgcggttcttttttattctctaggaggaaaaccaatgaaattaaaattaaagtcgggagcccaaatcttttttgaagatgaaggacaaggtacacctattctgtttttaacgggctttggaggcaatactgaaatttggtcgggacaagtgaacttctttttgcaaagaggttatcgagtgattcgattagattatctaaatcatggtcaatctgatcgagtagatggtgaacttcaaatcggagatttagcggatgaagttctacaattagtagattatttacaattaaaagaacccatcggaattggtaattcgatgggagcagcagtattgtggaatattattaaccttcgaggctgggatttcttgagtaaggccatctttgtggatcagtcacctaagatgttaaatgatcaacagtggcacctcggatttaaaaatttagcggaggataattttgatgaagtaatgaacgaaccgattgtccgtccagcctataaacacattgatgattttgtcttcaaaaattctaaggccattgattcagcctatccattttctcaacctcagaaccgagctttggttaaggggcatgcgaaaagggattggcgctttgtcttagaacaggcgacgaaaccagtgttgtttataatgggggaaaaaagccccttctttgatagcaccaagaccgctgaactatctgccttaaatgctaatatcacggttaatgtaatgaaaaatgtggggcacattccgatggcagaggaccccgctgaattcaatcgattagtattacaatttgtctaaggttgacgggcaaggtttgcatatcacattttaaaccaatataattaacaccaacacatagttatttagtatggaaagggagatttgctgtgaatattggattgtttaccgacacctactttccgcaggtaagcggagtagctacatcgataaaaacactacgagaccagcttgaaaagcaaggtcatcaagtgtatatcttcactactacagatcctaaggtcgataccaatgtatacgaacggaacatctttaggtttacgagtgttccgttcgtatcttttacagatcggaggattgcagttagtggatttattcgggctgctcagctggtcaaagagttaaacttggacattgttcacacgcaaactgagttttcactaggctggatgggaaagtttgtggctaagtctttgaaaataccacttattcatacatatcacaccatgtacgaagactacttgcactacgttgctaatggtaaattgctcaagccatatcatgttaaacagatgacgcgggccttttgttatcatatcgacggaattgttgctcctagtgaacgagttttagatacgattgaaggatatggcattaacgttccgattcgagtaatcccaacgggggtcaacctagaacagtatcaaaaaccaaacaagcgtaagcagtggcgagaaaaattgggttacgacgaaagtagtcctattcttctttcactaagtcgtttagcctacgagaagaatattcaagaagtgattgatagttttccagccatcttaaaagaggtacccaatgcacaactgctaattgtaggggatgggccagcgcgcgccagtctggaaaaccaagtgcatgacttacatttagaagatagtgtccaatttaccggagagatcaacaatgatcacgtctatggtttttatcaactagctgatttatttgtttcagcttcagatactgaatcacaaggtcttacatatattgaggctttagcatcgaacttaaaggtggttgctaagtcaggtccttatacagatgtactactagatgatatttctttaggaaaagtgtttaatactgaagaacaattagtagctgcaatcaaggactacattgaacatccagatgcttataatgatccagcaccacgtgaaaaaaaactctatgagatttcagcggattattttggtaagcaagttgttgattactatagtagtgcaattagtacacatacagatttagagttagacgaagattctgaatagaatcgggtttaaaatcagaataattttgtttaatgttaggggttaaggtatgccaattaaggtcaacatgttttcatcagctagtaaggtaaaggggcaaggtgtcggcagtgcgtatgaagaactcattcgtttgttgaagacccattttccaaagcaaattgatgtttcaatcaataaatttactaaggctgatattagtcactatcacaccatcgaccctaatttctatttatcaaccttttctaaaaaaaggggaattaaggtcggttatgtgcactttttaccggaaacgattgagggaagtttaaatattccacaacctttccgttctattttttataaatacattatctcgttttataagcgaatggatcatattgtagtggtgaaccccacatttattgataaattagttgcttatgggattagtcgggatattattacttatattcccaattttgtccgtaagaatgaattttaccgttttacagaggtaaatcgggatgcggtacgggaacgtttggaggttaataaccgttttaccgtgctaggcatcggacaagtccaagaacgtaaaggggttaaagattttatcaaacttgcggagaataaccctgataagtattttatctgggcaggaggtttttcatttggtcgattaaccgatggatatgccgatttgaagcaggtggttgataatccacctcgtaatttaaaatttacggggattgtagatcgtaatgcgttggtagaatactataatgcggccgacctatttctattaccttcatacaacgagttatttccaatgtcggttttagaagcctttagctgtggtgttccagtcatgttgagggacttagagttgtatcattccattattaaggggtactatatacctactcaagattatgaggatatgaatactcaactcaaattagtatcagaagataaagaaaggctgaataagtttaagcagctatcagacgaagcttcggaagaatactctgaagaccatctagctgatatatggttagacttttattcatctttgaccaaatagggggagtttatctatgtcaaggaggaataaagtagtccttgcggtgatgattctagctggtattataatttttggcttttcattacgaaacgttaatttgaatcagatggcacgggatgttgtccacttgaatatgtggtggctacttgtagcttcaggatgcattgtgttatacctcgggttagaagcagtagctaccaaaatgttgattcaaagtaacggggatcgtttatcatggagggatgctatccgaattccactaattgaacagctgtttaacgggatcacacccttttcatcagggggacaacccgctcaattggtggctttaatgcaaaatgggattgaaggtggtcgagcgagctcggttctactaatgaagtttgtggtattccagtccatggtcgtcatcaacttcatttttagtttattgattggctttcagtaccttgaagagaaaatccgtttcttatcttggttcgtcttatttggctttttaatccatttagcggtgattattggcttgttgatgattatgtattggcataacttcactaagcggctgatatcggttatttttataccaattaagcattttgtcagtaaggaacgttacacaacttggaaggttacgttaaatgagaaggtcgactccttttatcaagagagtgtcaggatgaaatcacagtggagattactagctaaagtagccctggtgactttcttacaactgcttttctactatctaatcccgtattttatcctattagctttaggaaaaagcgatgttaatatcgtaatggttacttgtttacatgtgctaatcttcatggttatctctttatttccaattccagggggagcggggggagccgaatacggctttagtgtcatcttcgctcagtttgttggtaataatagtaagttagtcttagctatgataatctggagaatcctaacctattactttggaatgttcgctgggatggtagcaactgtagttaaacctcataaagtaaaccgcgtaaaagtagttaaaaacgagtgatttcactcgtttttatttttttttcaaaaaagggttgaccaatccccgttatcttgataatatatttaagtgctcttctgaagggcacgtacgactggttaaacttcaaatcttgataaaaaagaaatgaaaaaagttcttgacaagatataacgaagtttggtagactggttaagcgaggttaacgcctcggtcgttgagaatgagaaattgtttaaaaaaacttttcatatttattttgatttttttcaaaaaagatttccagccttcgttttgcacaacaaaaaaagagctccaacccccatacgacggcgtttcgtcaccatgttggtcttcactcttttagtttttctactataaataattaaaggtcttctggaatatcatcaataggaaccaccgtcatagctccttgccgataaacattaatgtgatgaatgtcgtgggctttgagcatatctaaggcatctcggaagtgatcttcatagtgcgctgcgtcatgggcgtctgacccaatcgtataacgcttgccccctaattgcttgtagatttcaattgcgtaatcatacaaaccaatgttgtggtatttgtacatgctcttggtgttcaattcaaaggccaagttattttgaatggcaactttaaagatgttagtgagcaagactccggccgtggtcgagaattgaccagacgtcaaacttaatctccgtaccccataatcgaagtgagctaacacatcggcgtcatggaattcgttgattcccttccacatcaactggtaatactgatcggtcacttggagcggatctaagtgcgagacaatgtcactcccaaagtctttcgtaccatcttgatggaaacttagtaacttaatatcgaacgtatggtgggctaaatagtctttaatcttatctgcttgtccggctgacatcccgatttcaattcctttatgaactcgtttgcccgtcgcttttttcaaacgttcaatttcggccacgtatttagtgtagtctggaatactatcatggttttggacttctggattgttaaattccaaatgttccgtagaaacaaagtcctgtccggccaacttcatgtagtcttccatcttttcatttgaatcaaacgaaaagcttgtatgcacatgctggtcataaataatcataattttgccctcctcgttctaaaatgtatccgttctctactactattttagcatagcaacgcattttaacgcttgtctcaacgcttggagaggatagggaaaatgattttaatcgagatcttcaccgtttgtgcgaattactttttgataccagccaaaggaatctttcttagagcgttggagcgttccgttgccatcatcatccttatcaacatagataaagccgtagcgtttagacatttgaccagttccagctgaaacgaggtcgataaagccccatggagtataacctatcaagtttacgccatctaattcaactgctttttccatttcttggatgtgagctcggagataatccacacggtatggatcatgaattgccccgtcactttcgaccgtatcgtaagcccctaatccattttcaacaataaacattggtaagtggtagcggtcgtttaaccaattgagggaataacggagacccactggatcaattggccaatcccaatcactagttgcaagatatggattttcaaccgttacgtcttctggagctaagttttcatcaattgacagaccttcaggaagagccacggtgttggaattgtagtaactaaagcctacataatccactgttcctgctttaaggatttcacggtccgcttctgtaatgtctggacggtaacccttttgttgcaagtaagtttcaacgttttctggataaaccccgttgacatgcacatcggagaaccagtagcgacgttgcattaaacgttcagccaacatgatgttatttggggctgcattgagcggataaaatggcgtgaaattaatcatgcaaccgatttggaagtctggattaatttcatgacccaacttaactgctttagcactagctactaattcatagtgagcagcttgatacatcgctgcttcacgattttcatcccccttgaaaactaaccctgagttggtagccatcaagaagtcattattgtatatactctgattattgatttcattgaacgtcatccaattcttaaccttatccttgtagcgtttgaaacaagtttcagcgaaacgaacataaagatcaattacgtgacggtcagaaaaaccattgtatttcttaactaaatgatagggcatttcaaaatgtgccaatgtaattaccggttcaatcccgtatttcaagcattcatcaaagagatcatcataaaatttcaaaccagcttcattaggttcagcatcgtcaccattaggaaagatgcgggtccaagcaatcgaagtacggaaagcttttaagcctaattcggcaaacattttaacgtcttcacgataatgatggtaaaaatcgattccttcgtggttagggtaattttcacccggcactaccccatcggtaatcttccgcggtaccttgttagctcccgccgtcatcacgtcggccatgctaacccctttaccatctgcttgccatgctccttctaattgatgagcagccacagcgccgccccataaaaagttttctggtaattttgtcattttcatccatcctctcttttaatgagctttttctgtagaaagccttttcatagataagtttgaactattttccattttttgtatagctttcacggcaaacaaaaaacatattccgcagataaaacggaatatgttttatttattttgaagtgatttacgttcgggactaatccaagtcccagaaccaaaaccaaaaccaaaaatcgttttaagagccggtacaaacgtcatgaccaccgtcacgggattgaccatccagaaaaagagcatataaagcggcgcaaaaataaggtattttaacttagcagcatgatgatccaaaattaaagccgctaataattgtaagaacccggccagtagctcaaaggtaacaaagataaaagacatcacgattccgtgaaagacccgttcgtaattccccatcagtaagaaaaccaacatggcaatgataaaaacagcggtggtaatcataaagaaaaatgaccagataatggaaagggttgagtcaataaacatcgacatttgataacgatgcttaatcggatgtaagaggaacttcttaatattggtcaaccacacttcagttcccccttgcgcccaacgcttacgttggtgataaagatctttaagggattcggggacattcatgtgaaagacaatattgggagcaaaccgcggaatcgccccaatcatctggtgatcccaggcaatactaatatcttcggtcgcccgattttgccggaagcctcccacgtcaatcagaaaactcttgcgatacaacgtgttggcgccactgtaggcatacatcgaatcattaattgaagtttgactgcgtttgatgaccccaacaatacttgaaaattcaaccgtctgggccttacctaaaatcttcgtgcggttttgaacatccatattagctgttaccgccgaggtattcatatccaggtcgtgcatgaaaaagttcatgtacttcatcaaagcatccggttcgggaatcgtatcagcatcattactaagaatgtattcccctttcgcaaaatacatcccaatgttaaaagcgtgcgccttccctttattttttaagattttaatcgtccgcaggcgtggatattgttttctcaagcgtgctaagattgctcccgtttgatccgtcgagccatcgtcagcgactaaaacttcaaaattagtgtaattaatttcgttaaaaagataggtgatcgtttcttcaatcatgacttcttcattatgggctggaatcatgatggtaattaatggttggtccgcaggtagaatattttcccagccttcatcccgtttatgggttttcaaaaagcgatacgacaatgaacctgtaaaccagaagaacgccccgattacaggatataaacaaagtatcaaaagaataatgttaatggtcgtatcaatcagggatcctttgaaaatactatcaataaagattgatgacatttttgctccttatccgagatcgtctaaattagatgctcgataaatttctttaatttcgtctgtatccagattttgttctggttttacttcgtagtacctggtattttcacgaaattccttactgccaaatcgggcgtccataaatgcttctaatgtatcttcccgtcgacgctgattaattggattgtaggtaggccactgttcagccagccgatcccgtcgccgattttgaataatcgtcatactcgtcgcaaacaagctcgccatgacaaatgcaaaggccagtaagattccgataaatttaatttcaaaaattccttcactataagaccagatatgcggaatcttgggattataaatcgcccaaaaggaagtgacggtgatgatgataggaacaaacacacacatccaaccgaaaatggcgactaacgtttgccatattttcaaccaccagtgtcctttttcaaaatacaaatctgtatatagctgctgacgttctttttcgtttttcatcctaaacctgctttcggtaaacatcctccggcttgccaaaaagatagccttggcgcgcatcaatccggagctgctccgctaacgcctcgtcggcttcattttcaattcccactaaaaccaatttaatttcattttcttgggccaacttattccaaaattggagattaagatcgagccattcgttgggatctttctttctaaagctactcatggaagcctttaaaatatcaatttcgcttagtaaccactcaatatgtttcaaatcatttaaagatgaacctacattattaatcgtgaattgaactccatagctacgcccaatctgaattcttcttttaaaaagacggcgattggttagccgattcatttcatggattgaaagttcaatagctaaattaagtggctcaattttcgcaattgcccaccgcacaaagtattcaaaagccggactcataatttggttgtaagttaatttgatagaaagagttacatgctcatcggctagagattggaaagtcgtctccagtaagctaatcacgcgttgcagtggtagggattcaaaattacgtggcaaaacccactgtcccgcttcattttgcgtgcgcaataggcgctcgtagccaatggtatttcccttacgatcaacttgtttttggataaaataacgaagtgggatttcatcattccgtaaataatcgctccccttattccgggtccaccagtaatatcccccgataattccaatagtgatagccgccgtcagcactgtaatccaccataaatatatttcaagtttttctagtgtcatatcgttaacctttccgtttattttaaaactaaaaaaaacgattggcattaccttttggcgtgattttaatattttttaaactgataccgtttattattaatgatgataagcaatttcatattaaaaaacaacttaatttagcaattttgtacaatggtggaatatgctgtgtaatgctgtttcatccgttttcaatcattattaacttttaaagttctaagcgattgtgtaatcattaacatagtttcacagtgactaaaaagtagaaaataaaaaagctgtatagtaatcgaaaatcgatttctatacagcttgctagaattaactttaatggttaggcaataccctgaatgaattcttcaacttcttggggagtacggcgttcacctttaccaaaacggccgagttccttaccgtcttcaagggcgataaaacttggaatacccatcacaccaaaatgttgagcaacttctagattgtcatcacggtcaaccgtaatccaatcatattgatcgtacttcttcatgatgtccggcattgcgggcttgatgaaggcacaatcagggcaccagccagctgtaaagaataacattttcttacctgaattcattgcttcaaaaatttcttcgttagttaaatttgcttgagtgctcattttgaattgctccttttattaaaaactagcttactttttgtaagctgttatctatatcaaatattctatcagcttccagtcgttttgacaaccaattaatttgcccaatttaactcctcaggcgcgagttggtataccttgtccgctcgataggaattaatcaatttaaaatcttgtgctatgtatttttcatcccataaaaattggttaatttcacgtgaaacattttggcttcgatttaactcacagtgatagccgtcgggtccaattaccatcaactcggaaactttggctgctaccatcgaggaggtagcccactgcgcgggccgaatcaactgccacatagacatcattatttaaaattccatccacgctcccaattacgtttaaaacttcagcccctttaggaaacaagtggcgattacgaactagctttttaaaatgatgggttcttttattaggttcccaacttttggtcattacatctttaacagtatcctgtgaaagaaatccatgtaatccattgaaaggacccgcaatggtcactaattttttcaaagctggtaaacgtgaatctttgccaaacttaatcgctaaattaaccaggacattacttcctagcgaatgaccgaccccattgtactgttcgactccaaaactttgtcttaatttaattaataactggtgcatccaactaacttgccggcgttcaggagcccgattgttttcaaacaacacctgaaccatcggattagcgacctgctgatcgagttcgccatcaaaatccattgccccatcatttttgattttggccaccagcatcttttgcgcccagccatttttctgtgctccatgaatcaaatggtccgtagaatccgcatttccattaaatccatgcacaaaaattgttactgcattcatctctcattaacgctcccccacttaaaacttgcatcatccattctactacaaaaatattaaaagggctgcgcccaaaagaaagattactcttgagacgcagccgctttatgattaaaccaaaatggttgtttggtcatccatattttcaagtcaaaagcttgtaatggtaaatcttccccattaacttgaccatgttcattttcaaaagcttgcacgtgaatttctcgtccagttttaaagaaaacatccggcatatcgagatgctttccaccacgtaagagcttaataaataacttaacaaacttgaagaaactcaatttttcagtaattaccacgtctagttttccgtcgtgcaagttagcgcgaggtgcaatgccaacccctccaccaaaatatttgatattcgttagtgaaacgacgaaggcattcgcaaattcatgacgctcaccatcaatatcaatcgtaagtggaaatcctttttgacgcattgacgttttgaggagggccgaaacgtacgccatcgattctaagtgccacttgctcagcttaactttctgaccttgattggcttcatagaccactcgggcatcaaagccaatcccaatgttgttggtaaaatactgggtcagttggttcgcttgattctgataagctccaatatctaaggtgattggggtggtggtctggattaattgctgtaaggccgtggatggatcagaggcgatgccgactgcccgtgcaaaatcattccccgaacccgctggaacatagccaatgggaacggtgtttttagagcgtcgcactccattcagcacttctaggagggtaccatccccaccaatagcaacaattacccagccttgcggatgtagatcggcaaattcttgggctaactgggtcgcatgttgggggtattttgttaccacacgttcgaagttaacagcgttttgcacgaggagttgatggagctgttcccacgtatgggctgaatggtgcgctcccgcccatttatttacaataaaataatatttaatctgttcattcatgctagtctacatacttctccaaaaaatttgctacctcgatatgatagcgatgcggattggttgggagagcttgcacgtgatcggcttggtcaaccaaataaacttggctgggaacacgagctgcttccactaaatcatccagcatttcgattggaacataacgatcggcttcgccatggataaacatgatcggaactcgaacttttttaacctgttcttgaatattagcttctttaaatgagtaaccagcttcttttttggttaatgcactagcaatcgcctcaaattcttgcgatggtaaatgatagtagcgtttcaaacgatgccggaattgtttgtctaaacggttaaaactactatcttcaatcacagcagttaagttagtcgccatatctggttctcctgccgcagaaatcacagttgcggcacccatgctaatccccattaaaacaattttttcatccgtatgggttaataaaacagcgcgttgaacccaacgtacatagtcgcggcgatccagccacccaaaaccaattagattgccttcgctttcaccatgactgcgtgcatcgggcatcaagacgttgtagcccatattatagaagattttggcatacggaatcatttgcatccgggcgtgatggtatccgtgggctaaaataaccgtctttttagactgtttggcttctggttgtcgtaaaaatgatgctcgcaattgaaggccatcttcactaagcatactaatttcttctgggtttaaattattaaaccattcaatattgagggcattattatcttgagattgtgaacgttcaatggctttattcttagctttttccgtatttttaatcccaactaaaaaactaatatatccgccaattcccattccagcagtaattccgaaagctgcggcacctaagccagctaacatatatttagtacttttattcattaataacgctccttatctttagccaacttgctaaaaaacattatccgttaatggtaactttctctcattataatatcaatttttgggttaaaagtggtatgataaacgtgaaaacgggtccgtagctcagttgggagagcacctgcttcgcatgtagggggtcgacggttcaagtccgttcggatccattgaagacgttacagatgaacgtaaatggtatcaaaacgctggtatgtcagcattcttaattttagataatctcatataaaagcatacaatttatacgaggggtagccaaaagggaagccaaaaactggagtgatttaaacaatgaataataaaagaagcttgcggagacgcacctagaccaattatctttagttagatagttggtcttttattttgaacaaggaagccaaaaagctataaaaaaagatgtgcttaattttgcgcacatcttttactttgatcgcatttcaataatacgtttttcaattccatctctcaccattctaaatgcccttaatttgtcgctttctgttccttgaattaaagctgggtcaataaacccccaatgttctcttttaactgtagacggtgttacagggcacttatctttagcgtctccgcataaagtaatcactagatcactatgatttagataatccatatcgattaacttagacttatttttagagatatctatatttttttcatgcattactttaaccgcatatggatttaatccgtgcacctcaatcccagcactggcaattacccaatcaggaaaatatttctttgccatcccttccgccatttgactcctgcatgaattacctgtgcacaaaaaatatacttgcattaatgacgcctccacaaacattattctatctaactagtgattaaatcatatcaaattcttagcttatcaacatgcttaaattacaaatactttttattatcattgccacttttggcagtgatatgttttttagttcgctgtcgctcaaaacgatagccaattaatcctgttaaccttcaaaaggatatgaaaatcatataatgtaaaattgccgtctattataatttaactttttcaagggaggcacaattcattactcccctctgaaaaggatgtcctaaattgaaacttcctcttttacagagtatcacccctattgagggacttttttccaatttcgggagaaagtaatatggggttccattttggcacctcatcttttttgttaggatagatttacagctagattaaacacaaatcctagggaaacataatttttaataagaacaacaaaaaaactctctagagttaactagagagctatcgactaatggaggagtattccattgccatgataataacatatatgcgttcgctaaatatacttttaggcctgacataagacaaaagggagccttctagaatagaaaaactagaaggctccttttcgtgtaaggtaaataataaatccaaggaattgactatattttaatacttaatccagcaaaatactatacattttaaaaaataaaaccatttatcttgaatggcaataatttagaggattaataagtaattaatctccaaacgaacaccaaatcacgttgaccaagggtatcataatctacccttaattacagtaataacgtgtcacacaatacaattaataatacttgattgtgagcttataaagaatacattactctgtctattaaaataaaacggataataaacctatttcctaaaaaaggcacactattgatgtaaattatagtaacaatgttgctacatcaacgtttattcggggtacccccctaccctaaaaattttaaaagtagcatatagtgagagaacattatggcgtttcgctctttatcagaaagcctatggggcgggggttatttgactcttctcgactttcatataccttttatttaaaaaatagagccgttaaatattttaacgactctactaaaaaattagatttattggaaatggggtgctttaattataacattaaatgaccttacctgtttaaatttgcgttttttctagcaatctattagctattacattacttttcttttcctgttgcactaatgttcgatcttgtaattcaaaatcaattccacgataatacggaactttttcaaattctcttaaactatcaatgtattcatctaactgctttgaatatttcgccttcatttgttcattctttcgtatttcttcttgtgcttgtttgtttaattgttcaatattaaactcatcatttaattgctgcaatttttcatcagctgagacattgttgttccttgcattaattgaaccatggtattgttgaacttgctgattaagcctgtttatatctctaaacactccaccatcaacaacacttgctccatctgttattgtcgacttaatggcacgaagttgatccaatacaaactttacttcgaagttgtctagcgctgtagtgtccctatcattgatatatgctaatagttttgtatgaacacttgataatgctttgtagtacgcttgctgagccgttgtactatattcaggtttagctggtacttctacctcaatagatttattttttctcataatgttgttgtctctctttctattcgattcaattctttcaatagtttacttttagttttactgtggatactacgtttgtttaaattaataaagcttccacctctataatgtatattctctttttcatatgctctgataactgccttttgctctaaagaaaagctagtattattgtagttcattattctcacctcccctccctaatatcctaaggttcttgtaattctcattgactaccattcttcttaattactcttaagtcttctgtatctacaaaagcataagcaaattctattagtccactattaagtatctctctgcctcgactacgtccatagccggttaattctccaatttcataccaggtcaaacatttaaaatagcggtattcaataaacttccttttattttctcttatccctgcaagtgcctctttaatcttagctagtatttcaatagcgtacatataattattcatcttgctatcaatgccattactggtaacacttttattaggtaaatcacttaacgttgggcttttaatatccatatacgatacatgcgccatattctgtagtgtctgaaaatctttttcaaagaaccttttaacttgtttaattgttgctttatgatttatttcaagtagtagcatggttgtatacctcatgatctgatatagtagcctaaaaaatttaatctactcatactcagacgtatcaggggtaacttgttggtaagttgctccttttttgttgctcaatcacagctaagtcgttctgaacgacctagaaaaaattatgcattaattcttctaagttcgacctcgttgccttccatatcaaagtaacgacgtttgtaataatttccactggtatatattacctcttcaatagtcaacttattggtctttggaattggtaaatcatattttcttaagtaaaacgctaatccttcataatcctttttgcccaacgctttagttatccctttaatgctgtatcctgcttgtaccattgctttcaattgtttacggtacttttctagctttaattgtgccttagttttaggctttaactttaaactatccaatgctttagcaatttgagaatctctgcagtctaattcaaaggcaatttcacgaattgaacagcctactttaattgctgtacgcaaggctatcgaatacttattgatcaaatctgaaacattagtaaacttaatcttacttaatacttttaaagcttgttgcttctcggttaatttcccttttctacccgtttgaccttcttcactactttgttgccttagccctctagcatatgaccagaagcgagcacacacatcacaatttataatttcacaattataaggatcatgagtaccttgaatacgagttaattctttagtcgtgtacttcatcattttcaccttctaaatatagatcgctcattcctaacaagtctgcaatgttatataaccgttcttgcatcaaatcctgtacatcttggatcgttacaggtctgactgttccgccttctttaatatcgccccatgatttagcatctgcgatttcaatagcatcctttagtgcgtctctcacattttcaaattctgtcatttctatttcctcctaatagccgtaattggcttctctaaattcttgtagtggtacttgctttaaaatctttattacttctttgtacttaaccatcaaatacccaccaatcatggtataatagtattcgtagatagttactggcgaataggcatacctttttatggaatgtctatttttttattcgttcaatttggaactatttcaatagtagtttttaggataaatcatatataaccattcatctttggtagttctggccggtaaatggttatattttttataaaatgtgttattcagtcttcaaagagtgatgttccacttttgttcttgttatgttccacctaaatggaacataacaacccttacagccacagggctttaactctgtttgttccactgttacacttttttcttcaaactctttatatatctttttttatttactctataaccccaattaggttttataagtggaacaatggaacataataactataaatactgataaataggcatttatacatgttccacttttgataaattaatggaacattaactggaacatggaacataggaattaaaagtcttttcggtttccaaactaaaatcatgtgagtaaaccttatttaatctatctaattctttaattgattcctcaagattagctttaacttgttccctaaattgttccttgtttgttcctaaagttgtacccaaaaatttcttacagcctctaactgtgttcctaaagttcctaaaaaatatcactccaaaagcttttctatataaaaagcatatacatactctttttttgcataattttaaatatatacataaattaaggaactttaggaacgaatccctttgtatcagcattcttaagactattttttggaacgttttaaggaacgttttaggaacacttttaggaacattgttataactaatcattttcttttaatttaagaccaatatatctatgaactggttgttccgtggtactccaacctttacgattcttaatctttttgatacccaatctttttaagttagcggtaatagtttgtgctgtagccttatcggagtagttattcatatgacaaaattctttataagcacttaccacataactagccttctcacccttatcactggttaaatcaatttcacaccattcatctataaattcgccgaagtgatcattggacttatgccattgttcagatgcttcaattacacttttaggcttctcaaagcgtctattatccaacgctactttaaaagctcttaaacaagcatatacaaagcagttacgctcttctttaactgctttcatatcttggttatcccaaaaataattatctggttgccttgtatcaccatttactaattcgataaccattaatctatctttaaaacctgttgaattatcactaaaggttggtagttcgttagcgctaaatagtaatttagcgtagttagtaaaactaatcccttgtacccccttagcttcggcgtctgctccatctccacccgttaatgactttaaaacgtccgtattttgtagataccctttttcgatatctgccacaatattagcttctttttgatacagctgtatcatcttaaaccggttatcccccgctaattcttttggctttacagtagaaacgttattaatacccaatatgtcatgaataatataatttagtaacgtgcttttgccttcgccaccattcccgtgtaaaaatacggtatcctgaataggttcgtgcgaatggtaaaacatatatcctaaatactgcttaaacattggtacaacatctttagtcatcattcctgctaataacttatctgtgtgtggggtcggttctccactcatatctaaatcataatcgtgataattaactagcacatttgaagctttatgcggttctaactgttccgtcttaaaattataggttccgttcttaaacgctactaagttagggttagattcatcaaaagggatggtgcttacatcttcctgcaacgccttagcatagacatattcagctactgcgttgctagttttgatatcccactcaatgttattttcttcaaatttattaataataatctttttaacaaagctttttaattcattgttattgaataatttccacacaccatgtttgctctgatacctggcgccctctggtaactttgaatatctttctattatattttctttgagaatttcattacctaatgtcccaaccaaaattcgcattttaactttttgtgttcgtctacctgcgttcactaatgtaaatttttgccatgctggtgatttttcacttaaacaatttacatatttaacccctagcaatttccattcattggcagtatagtcatcaaacgataaggtgttaaaattaactaattcggacgtctgtttctttcgattactttctgattgctcaaagtctttaataccttccataacttcttctggtatctcgttcaaacgctcaccccctttaatcgtttagcttctctttgcagtacagatttaaaaattccgtttagttctttatctgataaagctggattaacaaaatgttggttagcaatgcaagcaaattcatatactactttaggtgctgtgccttgatacaacatcttgcctatcatcttagttaaataggtatttctctgccctgtagtggctccttgtgccatctcttctaatagataagctccataacgtttaatattgttgtactgagcggaattttccgctgagtgactgggattaacttttgccatatcaactagccacatcggtgcctctttgatatctttaaagctcatatgtttagctggttcatatcctctagaaggtgctataactatctggtcggtaatgatttctaccccgttacccagattggtcttgtctcttaactgcttagcattcgtcttaaagaagaaatgcaaaccgttatgtggagtactttcaaagtaagtttcactaaagaaattaccatgctgttcagcaagcttatataacgcctctgtaccatttttaccttctgtgtgtctatccacatctaaaacaattaaatgacttgtatttaatcgtatattgatatcagtagaatgcttaaacaaacgttttaatttctttagttcagtcgttgcgtcatagtgtccgtgtggagtaaggggctttttatctttagtgggataactagcaatacccaattcagcaagttctaacgctttattaattgcttgcacgtccactcacctcgtcaatcggtctaatacaagcttctacatccttttgaatttcttcaattaaatctaaagccgtcctacaagtaaaaaatgcacgatcatccatataactcgcttgtataaccatatttgtatgatcattattttctacagcgtcacttagattcgctaaatcattgccaacataactcaataaagcacttacttgaataattttgtaattagtatcttctaaatctggtaaattatttttcatgtttgttttacttttaggaatttgttagaattgagtacaataaaaacgctggtaaacgttattattccgccattcatcattgccgtgatggatggtttttttatactcttttttttcattcctaatcctttcttatacttagtattaagcctccgcaagctttcctaaaatttcatattttccataaattcatcaatatcattcttatcaatccgctttaatccatctggatcaatcactctcaaacctctattaatgaattctttcttaaatgtattaactgcaactcctgcatagcctgaagcgtttttaatagtcatatatcttggatacttttgttgttgtacaacttcactaaatgcttcctgtgcactttttagcatcacaccatgaataacattcaagctttcttcacttaacgttagtggtatttccatacttctcgcctcctaatagtgtgctttacctaattcataggctcccagcactaaaatcgtgcataacagaaatgcttttactgatatatatgccaccatgacttagttcctcgctttctctggtatttttagcgttgtttgatagataacaccttgattacttaaaacgtctttaatcgcttgataatccattcctaaatcaattaaagtggttatctgattttgacgtttatttaaggcgtctaactctgctttatttagaaaatctaagggagtagctttcttgtccacccttctagcttcgcgcaacttgctaacgtcaaaccctaacgccgttttatacaacaatttagtaaagttactgtacacgtaccatttatcactcaatactgagctttctttaatagcgtcggtcatttcacgtctaccagctttacccgacgtacgaactaactgacgctgtaataactcggttttcatagcgtaaaactggcgaactaactctttcttaaatgctcttacttgcggtgtgttatcaagataagtaattaatagtgttgcttgttcttcactaagttgataaatctttttaggtcgtccacgtccacttaatttacgcatttcaaatgccaatattccgtactcttctaaatcatttttatattgcctaactagttggttcacagcatgttttgaaacccctgcatactccgctatcatatccgctgttgtaaatggttcatcatacaaactaaacgtttccgtaaatactacgtttgatttcattttctacacttccttataatttatttctatagggctttagcacttatcactactggatcgttgttttagtgcaatataaatttgaaagctcttaatttgcttaaattacttttcctcaacctacatagataacatagggtgatactatttaattcaagtaaaaaaaatctgaaatcaaattttagattccgtatttctcatgcaaatattcataaatcccattaactaaattttcagcaccaagtccaacgtcttgtttgtttattgccctattcagaaacgttcttgattttccaaatttagcggacaaagtagtctgtgtttcttgtttcttgtggttagcaagccaagccttaattgcttcagcttttttatttgtttccatatggataaacatgggttcacctccatttataaatattgttaagaataattccagaaatttgttgcaatattctaaaatatatcttagaataaagacataattaaataagcaataaaaagcattctatatcgcctgccagccgatttataggtgtttttaatttgctctttttattaactatatttcttaacaagatttattctaaaacatatattagattttttcaagttttttctaaaatttgttttagattaatgaggttaaagtttggagaaacattattatgacgctatttgataagattaaaaaagtttccaaagaacgcggatattcaatagcagaagtagaacgtaaagctggaataagtgctaattatttatatcagtggaagaaaagagagccaagtccaaagtctctagcttctgttgccaaagttctaggtgtatctgtagattatctattgggtacagatgataaaccctctactactaatgaacccgtcgacctagacaaagccctatctgaagaaggtatagccatgtttgatggtaagccactttcagaagaatataaaaaagctctattggctatgcttagggctaataagaatagtggtgaatagtattatgcacaataatttacatgatgatttattggctcgtcttatttatatcgcggataaagcaggaattaagatagaaaacattgaaggcaactctgcagatcctgatgttgcgttttgcaaaagcaggattatcaatttaaacaataattttgaatgtaatattagcgttgcatttagacttgctcatgagattagtcatattcaattctcacagcctactttcctgtatactttctccccgttcatcaagaacaaagaggagcgagaaactaatatacgggccattaggatgattgctaaattaatctataatgacgtaccgaatgaacgcagaaattgggctaactttatgagtgaatttaaccttcctagttggttcgagccattagttaaggaacttatttacgattgattattaactctacgtccaaatactgattgacgttaaaaaagttgtacatatttttggaggaaatattatggatagtaatcctgaaaccaaaccactcactatacttgatataccggaagaaacacgatactggtttgttcgagcaaatagtcaggcacagtattataccgactttctgactaataattatgtatcgatcgatttgaacggcgtgtccctcaacgatcttttaaatatttctcccgcaatacgagcctcagaagatgcactgctacaagcgtataaaaatattttccaaactcatgacttaaaacaatttgatgaaaatccatcaaataagaaaaaagacgatacaactagaaaaaaagatcgaacatctgaactcactagaagttcaaatagagctactagagcttttcattttattgaagattttgatattggggactttattgttgttccttataagtcatcaattaaattccttataggagttgtaacttctgacagtttcaccaaatctatcgatcatactgaaatattagatgatgatggacaaatgatttatgatgtttcacctttcactttaaagcgccgtattttatggataaaagaactgccaagaaaaaatttcccggataagctttcttggattaaaaccgcacatcaaagtatatttgaatttactagtaatgcaaatgagcttaatccatatattaatccattctacaaatataaagaaaactattacatgaggattggcgtaaatacttccgaaaagataagttcatctacttggttagaatatcaacttatggtgaagaatattcttggggaaaacttagacgatgtgtatcaaaaacaaaaagttcaatctcctggagatattattcaatatgtgacccctcagaatcttgcacttcttattactcttttcaatggattatttggtgaaatagaattccatcatggtgacaataccgtaaaactgcaaggggttataagatatttttccaaaaatgaacgtttaaaaagacaactcgaaatcataaataaacaaattaaagaaaaagcaagcgaagctgaaattgcaaataaagatgctgatactctgacaaagttagggcaattacccaataataaaagccagcaaaaatcaattaacgacgccaccagccgcattgctaattcaattgctcaaagatactccgaaaatagtaaaaaaatagaaaaaaacttttttgaaaaagaacaacctgttacgcaaataattaatgagtcatttgatgagactcaagtcgaagttgtaaaggataaacttaagctttctaacgagaatctcggaacacaaattccatatgaaagccaaacggataatttgaatccttcagagggcgaatccgaacaacaaacactagaaacaaatagacaagaaaacaacaaaaattttggctctgaaactgaaaaataatcttcaatagtaagactagcgaaataaaaaaagctgttaacgtagcatagccccatatgatttgcatgaatttcaaaatattcacctctaaatgaattatacgccattaacaaaaaagccacatcccctaaccgccaagtaagatgttagaacgtgattggccgatcattgcagctaacatccctggtattttcttagggttttttacattctataccgcgttacattaatactttatttacaaaggagcgaatagtttatggaaacgagtattatggctatcattggaataattatattttttattggagcattaataataactcttggtcgaactttaaatatcttacgtttcttttttggtgatcgtagtatgtttacacagatgttttgggggattatctttatctgcattggcttatttttaatcatacttggcagccctcagcttaggtaatatcttttccccactccggtgactagatacagtccgactctgtatgtgggaattatgtccaatattaattgacgtataaattacactaacttaatactgaatagtaactcaataattacgatagattgaagagattattaaaatgaaaaagataaattttattatgttaggcttaaccattttcacatttacttccatagggcttaagaaggctactaacaataatgatgtagaaactgatcgtataaaacatagtgtatttcataaaaaacgtttatctttcaaaaagagaaagtaataactctacttatatattaagaatcaatatacgtaatgttgtacaactttttagttagtaaccgttgtaaaaacaagaaaaattgaaggtaaggatgcttgttaggaggataactgtggaactctttattgaaggaaaacaacttaaaaatgctcaaatcagttttgacagcaataataaatttgatggtttcagtgtgccagttagttttgagaatgacgctaagttattatctgaacttaccaataaagctactggactatataacggacagaaaatagatatattgagtattactaaaatagaaaattttatgtatctagtacaagcaagattatcgaacagtagaagctaaaaatagaaatatcaaattactatggtaggcatacgattaatatggttgataacattattatgtatacaggattgggaataacaattattggtttattattgttagtatttactacaaaatgggtcaatggctggtttataaattacaaaactactaatcgaccacttgcctttgttggctggattttattgttgttaggttttgcagtctttatacttccactttatctaagtgggagatgggattaaatctttaagcagccgattaaaaagatgccgttaattttaacgagatgttagatcagctcaattttgagcatattgaaaaagacctatccaattctggataaatctttaatcagccgagttttcgacctattgaaaagatgtccccaatttgggggagatgtttcatagtagacaggaattttcccgcttaataaaaataggtgcttagttcggcttaaatttcagccgaatctatttttgaattgagtccttatagtagatcattaacagagatgtactgagccgaattttcggttgagtaattaatacatagatcttaattatcgtacttatcaagggatgtactgaacggatttctccgcttagcaagtgctataacaaggtctgccgaattttcggtcaccattacttttcgccgaaattggcgaataacatttactattactttctcccgaaattgggaatacgtccaaatactgattgacgttaaaagctgtacatattttattaggagttgtttttaagtgataaaagagtttaaagaatttatttctcgtggtaacgttctagatttagctgttggtgttattatcggtagtgcttttacatcaatcgtaaaagctctggttaactatctaattaatccccttattggattatgtgttggtggtattgatttttccgattggagtttcaaggtgtttgatgcaacatttaaaattggaagctttgttaattccgtcatcaattttttaattattgcatttgttgtattcctaattgtgaaattcgtaaataaattaatgcctaaaaaggaagaagaagaagaggtcattcctgataataccgagctgtatttgaaagaaataagagatgcattagttaataaatcagattcttcaacttttaacaacgaggaacctaacaaataattattcgaggcaattatgctatcaaagattctttttcttattggagcaattcttttcttattggaccttacataataatattaggccaaactttgataattactcgtcctttttaaaaaaacaatagtataggctttcgcattttttggggtgttatcttcatgtgcattggtctaatactagtaatactttcgaagccttgatcgtctttacaagaaatatattcctaagtcgatcaagtctatctcacctatggttagcacgtctctgttcgattcagagagtgggagtaagggatggtgttcaatcatccctaatcattgctaaatcactatcatagtttaaagcctccgcaagcttccaagttatggagtgatcaaaatggcaaaagtacaaaagtatcttgataaaaacggcaacaccaaatacatgtttcaactctatatgggaattgatccacagactggcaacaagaagcgaactcgtagacgtggttttaagacaaaaaaagaagctacccttgccctatcccgtttgcaattggaattagagaacaaaagtagcttgcctactgaaaacaatattttatttagtgaagtttattcggaatggtacgaccaataccaaaacactgtacgtgagagtactctagcacgaactgatggcatgtttcaaaatcatatattacctgcgttaggcaataaacgaattagaacgattaccatcaagcaagttcaaagcgccgttaataagtggtttaagcaagtctcacagaactataaacgttggtatcattataccactcaagtatttgaatttgctttaaagcgtggttacgttgtctctaatcctgccaaactgataaccttacccaaacggcaagaagccagtggcgacaaggactacaatttttggaataaatcagagttgcaacgtttctttgaccatatcgataaagataaagagttggagcgcttcacattgtttagaattttggcttttacaggcgttagacgtggcgaatgcttagctcttacatggaatgatattaatttcactgattccaccctgtcgattaacaaaacccttactcaagggatgaaaggtaagcaaatcattcaagcgccaaaaactaaagccagtagacgtacgattgatcttgattttgaaacggtggccactttaaagagatatcgagtttctcaacaaaaagagtttcttatacgtggatataacaccatgcaaaaagagcaacttgtattccctaatacgttaaatggctataagtccttgaacacaccgtcaaaatggcttcacagtattattgatggtatagatatcaaaccgatcaccattcacggctttaggcatacacattgctctgctctgttctctgctggtgcaagtattaaagaagttcaacaacgattaggtcatactgatgtaaaaacgaccatggatatttacacgcatgttacccatgaacaaaataaagaagccgttcaaaagttagtcaattatcttaatttttagacaaagggaagccaaacgggaagccaacttaaaattaaaagccctgtaatgccctataaacactggtgttaagccactttgctaaacaatggcgtcaaacccgttcggatccattgataggttacagaagtgtttaaagagtaccaaagtgaataccccatggctttcagatgtatgtatctaaaagtcatggggtattttatactctataaaaaattcattactatggcaacaatataggcagtttacgaccatatccaacccttacacccgttataattgctgtttctccactacctatagtttcccctattaatccaaatcgttatccaactttctgataactttcgctggcactcctgctaccaaacagttatcaggcacatctttagtaacgaccgcacccgcagcaaccacgacattattgccaatcgttactcccggtaaaattgtacaatttccaccaatccaaacgtcatttctgatggtaaccggcgttccttgcgccatcttttgtcgacgttgcttgggagacattggatgattgaccgtagcaatcagcgtattgggtccaatcatgacataatcaccaattttcacgggcgcaatatcaagaatcgtgacgttatagttggttagaaaatcctctccaacatgaatatttttaccgttatcacaattgaaattaggctgcacatatacgtttgctccagttgaaccgaataaatccttaattgcggcctgttgtttttggtcatccgttggatcgatattattgaatcgcgcgcacttgattaatgctgcttgcttaagattggcaacttcttcatctaaaaagcaatattccaaaccttgttttaacttttcaatctctttcatttgtttacctcattactaacctagctgaatgtgagcatctgccaaagcttgctcaacaactcgaagcacctcttcactatgttgaagacgtagagcggcctcttttaaatccttttctgcaataattcgttgaaatgctttgaattcttcatacatgcgatgcgaattttgtttaaaatcaaatttttcaacccctgctttactttcaatatcgaagttatcaagaacattggttgctccattcacaactactgaacccttcgtaccttgaatcgtcgaacgaatcgtagccgtcgagtctttagctccgatacaaaccactttggtatcaggataatttaagattaatattcctgaagtatcgatatctttttcaatattagctagatatttgacgcttgatggggcgcccagcagccccacaacaaaatgaatgttataaatattgatgtccatcaaagccccaccaccgaacttggggttaaaagctggtaggacttcacctgctttaaaagcatcatagcgagatgaatattgcgaatagttacattcaaccaccttaatttcgcctagggttggaacggcttctttaattttttgataattcatcatatattgattggtgatagcttccagcaaaattaattgctccgtttgggctagttctgctaattcttctaactccgctaaattcaaagtgaacggtttttcacagataacattcttaccggcttcgagggcttttttagcaaaagcaaaatgtaaatgattgggaacagcaacatagatggtatcaatttcttcatttgcaagacattcatcgatgtccgtatatacacgatcaatcccatattgcatttgtaatttttccatattatctataccatgaggggttcctgtgatagcttttaattcaatctctggtaacaacggcgtcattgtaagaaagtcctttacaatcattcctgctccaacaattcctaatttcatcgcatactctcctatttatccttttaaaactcgcttttttgcattttcttgatgcctgtttctagcatttttatttgcaataaagtttcttcatctttaacaattttttctttaccgttgataattgtttcgtacaatccctcgtatactctgctgtagtctcccacttccgagacaaccttttcttcatggtattttccggaatcgtctaagtaggtcaatactccataatgttgtggcaggtcgattccaaaatcgggatggtctggcatgtaaaacatttttaaatgttcctcttggcgatctttggtctgtttaacaaacattccttttttgccataaactacgaaacttggtcgttcctttattctgaaataactcgatttaactgaaaccttcatcccaccatagaagagatccaagtcgaaataatcgttcatccgattttcacctagtagttgtctaacctcatagtgaacgttatccggttctccgaagtatgaaattacttgatcgagcgtgtggcaagcatgaccatataaatagctggtatctagtgaaaattcgtttaccccttccggaacctcggggcgatagtaatcgtagtgcatttccacctctaaaatatctcccaaaacgccactttcaatcactttttgagtagttaagaaatctgaatcatatcttctattctgatagcattgaaccaacaacccttttgattttgctaaatcaaatagttcttttgcttcttggtatgtttctgtaaaaggcttttcaattaacgcatttttaccatgttccagcactgctttaccgatttgaaaatgcgagctactgggtgttgatactacaaccagctgaatttctggatcattataaatgtcattaatatcggtggtataatgtacgccttcgattcttttccacgcagttgttttcgtgcgggaataaatggttttcactttaattttgtctttaagtttgagtgaaaatggcaaatgataacgattggcactttttccatttccaatataagcaattgttagcatcttagttcctccatttgtattcaaatattgctttgctatctacaatataaaacggggaacttttaaacgatatactttagggtaattctggataatactttcagaaaaatagaacttgtactgcttattcctaaaaaaaattaccaaaatcatgctgaaaatattttttaagctatactgattatgaataagccaaaaggaagtgagctatcatatgctattaatcgacaagctgagcaaccacgaaaactttaccaacaccgagcaacgaatagccgattatattcttaaaaacatcaccgacattccgccgatgaatattgataaactttctaaagtcacttatacctcgcattcagctgtggtccgattgactaaaaaattaggtttcgaaggatttaaagattttaaagtagcaatttcggaggctgtgtacagtaaaaccgccaacataaattctgttgatgctaactttccgtttgattctaacgattctttctctaccatttcaaagaaagtcgctgaactctctgttgaaagtattcaaagaacatttgcacagttagacgaacgactgattgaagaagcagccaatacgattgctaaatcggaacgcattttcctatttgcgcagggtgactctcagattcgagcccgtagcttccaaaataaattggttaaattaaatcgtttcgccattttgggtgaagaatacagtgacgaagactggacggctgccaacttaactaaaaaagattgtgctattttcatcagttatggtggtcgtatttcacaatatgaacgtatgctaactcatttttccgagaataaaattccttctgtagttctgactggcaatcaaaaatcgcccctcattcgtttggcacaaactgcgatcgtcactactcaaaatgaatatgactttttaaaaattagtacattttcttctcagatcacttttgaatacttattggatacaattttttctgttatttatgctaaggagtaccaacaaaatattattaatttaaaaaataagtttaacttgattcaacatggtactctttctgaaggcttagctaaggaacatgactcaaagtagtgcgtaaaatgattcaaaagactgttctaaagagagaacaagtactcatttctatacaaataattacgtccaaagtccaaaaatacgcctggtagtttccagacgtatttttttgagaacatattttagataatgtaatcacaaaattgaactaataactttagggaatcagttcattcatcaacttgtttgttaaagtcgttagttgatcccactcttgatccgttaaggtagcactaatgttacaattgtgttgcaattatgtttcaataagattattatatgtttgttcaaggacaactaataaataatatatagaaatggaattaattttcctggggggcattatcatgaaaaaaggatttattattgctacagtagccatgagtttaggaattattgcaccattatcacaggtagtcacctcaataccagtctccgcaaaaacaactagccattcatatgtaactacaacaagtaattctatttcagtaactaatatcagaaaaggatccacagtcgtactcaaaaataatatgggacaaactattgcaactaaaacagctgctaatgctgggacagtcacatttaatttaggaacacagcaagtaaaccgattaactaagactgacactttagcaattaaactaagttctggatataaatttaatatcaattttaatttcattaattatagaaccccagccagtaataaatttgtagctgggattccaactgaactacagggccattggcaagccaaattagggtatttcaccggtcattggaatatgaccagtaaccgctcaacattaacggttaatgatcctcaaattttaaataatgttcagtacaagaatttaggcaatcatacttatgtactaaaaggtactgaaagttattacagcaacggaagtactatccagtacacagttaaaaaggtaagtaacaaccacttaacattaaccactgctaatggagtatcacagtggtataaataatattatatggataaaaaagtctaacttatggaatcatcccactaagttagacttttttatgttcttactgaaacaagttgttctacgttttgctattcttcagactactaatgtgtatcctgattttgatcatcacgtggcttattttttgccaaaatatattgctcgattaaattaatgatttgttgattttgtggtaagtcagaatgttgagcatcatttcctgtaactgtaatttcagtataatgttgggcttggccctgataaatatatttacccgcttctgcgctccgtgctggtacaatcccatcattatcaaaattctgagtaccaataatcgaatagactgacaacgttttaggaattttttacgttgtttaataaagtctgacagcatctgagttttatgcgaaagtgacgtttctgagaaattataaggtgatccaatggtcattaatttcttgattgaaatatcgtcacgattgaaataattttcgagatacattgtatataccaaaccaccatttgaatgaccaatggccttaaaattattaaactgatattttttagctaacgcattaaatgcaatagaaaaccatttagcttgttttttaatattgctataaccatctttgttgttctcaaaaccaacaacaataaacggctcattatcacgtggacggatcgatcccgagtaactaatccgatcattagtatggaccgttacttttaacagactatggcgttttccacgcctatcgtttaacttatcaatcaacccatcaaatcgattttgcgtagcactactccccggaatgaaaataaccggtgacatatttgagtcatgtcgtttagaaatggcggtcacatttttatgcatccactgaattgatggccaagccaatattccaatccctatcaaactcgcaattaaaaatataatgctccattttttaacgttccgtggcatctagaccatctccctgaatattaagtcggttggataatttcacaaatggtcgatacagccaaacaccgattcctacgttaagtgccataaccaataaggttacccaattcccattggttccaataagggcctgcaaaagactgggcgttcccaacggcacttgataaactacagcaggcattaaatgtaaagcaatggcgcttgcagctattcctacgttaactagtggaactaatagaaatggaataatatatagaccatttcctaaaactggaacacccactaatatcgcactattaaagttaaataatactggcagcaacgaccatcggccaatcagctgttgatcacgttgattactgaacaaaaaaattgcaatcactaatgatagcgtacttcccgttcccccaatcgcaccaaaagattcatataacgtccctaatgaaaaaggatacggtactccccaaatcgtgtgatgtataagggcatagtttaaattcgcagtcattgcgacgccgttacgtccgaaatgtgccagtattggcatactggtcaacccgaaaaaagtcattatgccagccaatattacgatcgctacggaaaatagcaacgaggtttggttagcctttagtgattgtaatcttagaataacttgatctggtaaaaccgaaatcgccaaccaatttaataaaatactaaagcaaatcgccacaaccaacacaattataattgctcgtaatgaatctaacgcacgattccatgttactcctgaagaagatttatcctgctgctggctatttgccagatgcttaaaacttagtccaaccagatagcctaccaaaaaacctaaaaacaaacctcccatcccaagcatatcttgaccaaaagctaactcaccattatttgtataacgaaccgtaaggattaaataagcaattaaccccgttatactcgctaacttttcatctcgctgataccgtttagctgtataatgtgccatactaaatgcggctaaagcagctactattcctaacgttaaactcgtcaaatgatcaaaaataatttctatgaatcgataccgacttagccacgacgaaaacccaaaaattgttggcaataaactatttcgatttaacatagtgatttgaattagttgactgatactaccgataagaacaaatgggaataataaatttaaacttttttgcactaattggtataactcattttgttggagccgtattatttttcgaataatttgttctcttcttacccacattagattttccttctttaaactaatctctcctactattatctttattctagttgaatcattatcgaattgcacatcgcgttgctattatttatatctaacctgataaagttggttttaaaaaacacgtctggaactatcaaacgtgttttttaattaggtactaattcttccagattcattgatgggtaaaaccaaaagtttaaagctcgatctcttagatactcatcaatttcccattcgtcactctcccgtgcttcaaatgtatcatcgattcctcgagctataatttcagctaattgatacttacccgctggtattttatccattccaattaaatttgttgcagctttttttagttcatttaaattgctattagttttaatcatgattgtacccctccattattagattgcttacgctttcattgtataacattttcaaggaataactatcttaatatgaaactttccaaactatatcaaacaaaaaactgtagccgagcttgatcgccctgctacagtttttatcatctaccgtgtttcttttttcatcacatgtcctacgatgaaagtaattccataagatatgaataaaattacagcgacaatcatatatggaatgtgagtattgtaatccatcaacattccggcaataattggtccgatgacgttccccacactagttaaagacatgtttaatccattaattaagccttgattgtctttgccttccttagttaataaggtggtgatggccggacgtaaaacatcgaaggcagagaaaactactaatgtagcaatgattacttcaatttgagtatgagcttgggtaatccaaaaaacaaaaattgctccaattaagaagcatgccccaatcagtctcacttcacccattttccgcaccaagaaatcaaagataaacacttgcaaaatcaacgagaaaatcccattaaaagtcaatactagtgcaatcgttcctaaactaaaattgaagacttggttaacgtagatgctataaatactttcgaatccctgtaacccaaaggctgctacaaaaatcatcgtaaatagaattactagtggtgccgtcatgacactcttcaaagcattcggcttagtaaacttggtcatttccgtttcttctattttcacttcagtcttcggcattaccaaatacgtaaataatgttgaaaccagccctaaggctgcagccgcccaaaacggcactttataatggatatttgctaatacaccaccgagccctggtcctaaaattagtcccccactaaatgcggctgaaatccaaccaattaccttagccctttgcgccgtagtggtaacatcagatgctaaagccatcgacgttggaataaacaaagcggctgaaatgccaccaacaactctggatacgttaaatagtaataacgaatttgataaagcaaagattacttccgaaacggcgtagaaaaataatcccgctacaatcagtggcttacgtccaattttatctgaaactcgtccaactaatggagaagcgataaattgcgagaaagcaaacaatgccgtcataattcccatttgagtagtagtataaccgtaatgattcttaataaatggtgtgacgggtatgactagaccaatccccaaacaaattaagaagtttccagcaattaagatatataatgtctttctgtttttttcactcattgtaattcatctccttcgttatctgatacattctttcatgataacactcaatgaataaaaaagctcaagctcattacctatatcttacggagaccataattaccagtccaaattcaccttggtaatttcaccgttattaaaagctttaacttgtccatcatccaactttacgacgatatttccatactcgttaatatccgttgcaatcccctttacttgtttcgttccgacttgtaaggtaactggcttaccaattacgattgacatttttcgatactcggacaaaaagctgccatctaaataattttgccaattatctacaatcgtattaattaattgggcggcgattagattacgatcaatgttcggttcatttttagcaacaatggctcccgctttttgttgtaattcttctggaaattcaggcgtggttaagttaattcccaccccaattacaaacgcttgcgtagaagcagattctacttcggtaattgcctcagtaataattcctgccacctttcgtcgattcattaaaatgtcgttaacccatttcaatttaaatccacgttcagggaagaaatctttaaatgtttgtgcaatcacataggcaaccccagtagttattaagcccacctggttaatttcaaaagtgggcttagggataactatgctaaagtaaagtccttgttctttgggtgagtaaaaactacgtcctcttcgtccgtatccttgcgtttgctgctcgctaatcacagcaaatgccttttcgacttggtgagtagcgagatagtttttagcatacatttgagttgaatcgacttgctcttcaacagcaacatgatcaacacttttatttttataaaaattaatgactacttcatccaacttagagctactttcatatttgtaacctagatttttctgactttggatttggtgaccgtgtttctttaataggttaatatttttccaaatcgtttcgcgggtaactcctagattatctgctatttcatttccagatacccaacgatctcgatctttcaataattctaataaaactttttggcttgttttattccccatcttataaccacccttaatctatttaactagtttaagtgtactatcttctccaatcgattggctatgataattactaaaatagctttgattgtatcacctgggataaataataaagtagaaaatatggccgttgaaagtggcatgggtgcttgaatcgctaaccagaacgcaccaaatacatcaataaaaactgctcctccaagccaaacagaaagtaaactaagtattaattgattcttaattttgcctttcaaaacattcttgattaaattaattactagtggcgcaaacaaccaagccactaaatagcccccggtagctcctaaaaatactacggcaccacctaaaccaccggaaaggattggcaatcccaaacttactaataataaaaatattcctactgataacgttccatatctagtacctagcatgtcaccagccatcattactcccatattttgtaagacaatgggaactggaattaacaagagcggaattctaggcatcagccccatcacaatcgttaaagctgttatcattgctgctaaagtcatcatttttactgcactttggttgcttctctccatttttaaaacctaccttctttaattttgaaacaaattcattatatataatagtaacctatttttataaaacaaggttactattacagattttttaatcgattaatttcaaaatttttaggtctaaaccgtgttggagattactttttactcataattttggtgtaagctattcctttcttcattctttgacaaaatcttttcaattgtcacttctaaaattaatgatccacccgttgtacaaaaaaaccgaattaaagcagcattcaaactactctaattcggtttcggtttttaatttattaaattacatttcgttcaaaaggttggtcactgataccgtcatccaaaatctttttcgcccattctttagctgaaaatagtgaatgatcacggtaattaccacaactgtagatgtccgtacctggtacatcttcccacttagtaacatttgcgatttcttctagtgcacccttcaatgctttagcaacttctgtggttgtaggttctccccaagcaatcaaatggaaacctgttcgacatccgaatggagaacagtcgataattccatccattcgatctcgcaataatccagctagcaaatgttcaatcgtatgtagtcctgcagtgggaatcgcattttcgtttggttgaactaaacgtaaatcgaaattagaaatcttatcacccttatttcccgtttcaactgtaattaaacgtacgtacggagcctttacctttgtgtgatccaattcaaagctttctacttttgccataaaaacatccccctattcatcggtatctatgtcctattttagaccaactcgatcctgatataaattaaaaaattcatttaaaaatcgtcctggctaatgttatgcatcaaatgataactaaccatcattttttgcaaaggacggagattaacaacggggaggtaactaggcattctaacccgatcaaattcacgtccagttacatcttgatagatagaatataataacaaaatacatacaaaaattagcggaaatcctgcaaccgtacagattgcttgaacaacctcaaatccacctactataacaattcctaacgagaaaataataaacacgatgacccaagccattcgattccatcggctaggttggcgaccatgcgacaagtctagactggtgaatgatgaaacaataaatgcggaagaagaaatcgtcgttgctaagaagataaaacatgaaacacagaaaagaattagcatcaatttattcatcggcaaagttgtaatcaatgctgcttgaactgctgcttgtccttgtgtattcaaaatgtgcacgatgtttaaagtgcctgattgttgaagccatagagcatagccccctaaaactgcataaaatgaaatacatccaccgactccataagtcatcatccctaaaacaacttggcgaatcgtcttaccatgcgagatccgggcaataaataaccccattaccggcatgtaggctaaccaccaaccccaataaaacagggtttgatgttgagcaaaaccattggtgccagcattagctttattaaaggaaagcgcagtaaaatgttgcgccattaatttcaaggtttgaccttctgagcccactaaaaatttagttggaccagctactaaaacaattgctaagaaaataattgccaaataaatgtgccatgctgatagttttttaattcccttatttaaacctgcgtacacggttaacgtaaataaaatcaataaaataaagaataaaaatagttttaaataaatcgtatctttaatacctacgataatacttaaaacacgtgcaatcacgggaatttccattccaatcgaagaaccaattccgcccatgatcccaaaaacgactaagaaatcaattagttgacgtaaaacttttttatataattgatcgcccttcaagaggggaattacagtacttaatcgcattactggaattttttttacatacattgtataagcaatagcaatggtggcagttgcaaacatcatccatgccatcggcccccaattaaactcgcccactacgttagcataggcaaacgcttgggtcgataatggcttcgcgccaaatgccgggtgctgaaggtattgcaatggatcagttgcacttaacatcaaaatacttgcatcaattgcagttgcaaaaaccatgcttccccattgaaaaccactatagtctttagctggatcagcctttccgaatctgattttaccgtatttactaaaaatcaaaacgataaaaaacatgaaattgatgacataaattgagatatacaaccactcgtatttgcttgtaacgaatgacaacaacgcgttcattaattgctgaacggctgggccgcctgtgataaggatgattgatacaaccccaaataacaccattgttggtaaaaagacagctcgatcgacattcttactgtgtaagataaaaaattcctcccatattttcaaaaaattggtacaaaaaaagcaacaccattggcgtattaagttcacacctgcatagcgttgctcgatcggattgctccgaaattcgtcatacctgttactttcatgttactactattaatttaaatatcaaattaggctagatttgtttgattactctggcaggattccccgcaattaccacattgtccccaaaactctttgttaccactgatccagcacccacgacgacgttattgcccaaagttaccccaggtaaaacggtcactcgtcctccaaaccaacagctattaccaattgtaattggagcacctaattctacatcagcatttctcttaacgggatcaagtggatgaataggagtatacagccccacgttaggaccaaaataacagtgttcaccaatcgtaattggacacgtatcaaggaaagtcatatcgtagttgccataaaaatggttaccaatgtgaatattccatccataatcaaatttgaattcactctcgacaaagaaatcgtcacctacatcacctagtagttttttaaaaccactattacgtttctcattgtctgtttcgttgttaatcacttgtaattgttgacggatgaactttcgacgaccaattaattcagcatcaaactgctggtaaggttctccagcagtcattttttctcgttcagttcttgtcatatttacgcgcttccttctttaaattagcccttcttgttgcaaccctgcctgcgctaccaagttaataaaattaaatggtcgatcgtagtatggttggaataacatatccacaaatgctaaatctttcagcgtattttgattctgaattgctaaagacattgtattagccaattgagaaacattatgttcactaaagaattgggcccccagaacttttaaattgtcctgttcataaacaattatactgtttattttttccgttgtcggcataaattctggacgataattgtcctcatagctgatatatttgacctttaaaccagcatctaaagctcgttgataggttaaaccggtagtagctaatgtataaccaaacaattgtaagcctgatgttccttgcgaacctatttcaggccaacgattaccgaaaatattaataccaactaatttaccttggcgaatcgcattcgtcgccaatgggatatagctatctgtatccgtcggattgtaatgtacagtacgagcatctcctgccgcgtaaatatccggatcagaagtttgtccatattcgttagttaaaattgcaccattacggctcattttaacctgcccctctaacaaattagttaccgggatgaagccttttgaaacaatcgctacgtcaacttcttcattttgatcatgaatggtagtaaccagtaaggagtccttttgatccgtgaatgatgcgactttactattaagtttaactttgaccccgtgatcttccaggatttcaactaacattttgctcagctgtacatccacgtaattatttaaaatcacatcatgactatggtataaggttacttgacaacctaaatcagacaagctttctgctaactctgcgttaacatatcccccaccaattaatgcaactcgctggtggggttttaaaacttggtgtaaagtctgcgcttgttcatagtttttacatagcattactcgtttatgattaatgcctttaattggaggtaaggtcactgctgaacccgtgcacatcactaatttatcgtaatgttcgcgacgaatactatagtcttccatgttttgtaccaaaatctctttttgatttcggtcaatttttagaacatcatgtcgcaggttcacccgaattttttctaaacggagatcctctgcatcatcatacatcatgtcttctagccgttttacgcgaccattcagatacaatgcgattccacatgataagaaagagatattattattacgttcataaatatctacctccgtatccggattttgtcgtaagatttctctcactgctgctgtaccagcatgggtacacccgatgattgctactttcattttgcctcctacttgttttatactggacttacttgttaagaattttttacacgattccagatgctttatattttaattttagactggattaagactttgtaaatgttttaataaggaaaattagcaaactaaccacgccaaatttcaaggagtttacttaatgcttagattttttatccaaccgcagttaaatacgattgttgattcagtaattggttacgagatgctgatcaaagaataccgcgatgggacctggcgaatgcctgcttctttttcagcaattccagcccatgatatggcagaattactgattgcaactgctaaagaactatctcttaaagttggttcagtttcatttaatgttgatcgtaaccaaattcttgatgatcaactaattcacgctttaattgccgcccagacggttttacgtccagttaaattaattatcgaattaattgaaaatgatgttaaaccctcggtgtctgatgagcaattaattgaagttgttacgcaattgaatgactttggaatccaattttgtctcgatgacgttggtagcggaattaatacatggcctgcagttaagcctctactaccatacactcgtgaacttaaatacgctctccaaaattataaagagcatttggatgaatccgccgctgaaaatcacgttaccttttggcaaaacctagcaactaaacatcaaatgcgtttcattttggaaggtatcgaagatgataatgatgatgcttgggccgattctatgaatatcgatttacgccaaggatactactatggccgccctacactaatgaaaatacatcccgatgatcccgattaacttatgtaaagaaaaaccgcgttgcgagacacaatcgtaacacggttttttatttagtttctattcgatttcaattccggaagtcttttcaccactggccttaggtaaggtaattgataaaactccattatcaactttagccttaatatcttcagccttaactcttggtaattcgtaacttctccgcataataccatagcttcgttcggtcatcgtaacattatgcttttcatcttcatgatcagcaaaactatctttcttcacttccacatttagcacgccatcttgataatccaatttaatatcttttttatcaattcctggcacatcgattttaactttgtaatcagtatctgattcactcacgtcggtcttcaatgtttttgaggttccatcccagccgttgttgaaaaatccgcgcgataaacggtcaaaaaatggatcccacatatcattcctacgattcatcatttcattagccataaaaacaaaacccctttctaaatgattggtgaagttcttcgcttcatccttacacctataatgttagtcacattatagtattatgtcaattactttactcaagaaaatgttttcaataaaaaaaggcttacccaagaacaagatattgtccattgcataagtctttatctataattgtagatttagttttcagtattgattctttctgggaaccaaatcttaatttctttttcagcgctttctacactatctgaactatgaactacattcttaataggaccaggtccccaagctctggcaaagtcaccgcgaatcgttccggccattgcttcactcggattagttggaccagccattttacggaaggtgtcgataatttcattaccttcagcaataatggccacaattggaccacttgtcataaatttttcaatgtcggcgtaatatggtttatctactaattgtgagtaatgttgacgtaactgttcttccgttgcgtttaccatctttaaggctttgatttcataacgacgattttcaattcgtgaaatcacatgaccgatatgtccacattgaactccgtctggtttaactaaaattagtgatttttctgtactcattggcaaatcccccattggttttatatgccaattatatactagagaacgcctagtttacacgtaatatggaatgtaagccttttactaaaaaaatttttacttaatctttaacgccaacgcgttcaatgccacaataacggttgaaagtgacattaacaccgctccaactgccggactaaggacgaatccaatcggagccaaaattccagctgctagtggaattgcaaataagttatatccagctccccaccagaggttttgaaccattttagcattggttgcttgagctaatttcaagaagttcaagatatcacttggatcactgtgcacaaggactacatcagcggaatcaattgcgacgtccgttccggctccaatggcaattccaatgtttgctttagcaaggctaggcgcatcgttgatgccgtcccctaccataattacttttccttgctcttgatatttttcaagtgcctttagtttgtcttctggtaataattctccatgccattcatcaatttgaaggcttgccgcaattttttgcgctgtttgttggttatctcccgtcaacattaccggaatataacccaattgctttagttctttaataaaggaaactgcattttcctttatttggtcgccttcagctaatccacctaaaacttgattttctcttactaggaatgaaactgaattaccagctgtgctccatttctcaaaatcatttgtatcaaacttaatctctttttgtttcaaataagaggcgttcacaatctgatacttctgaccttcgattgtacctgttaaaccaatccctttttgagctgaaacatcatgagctgttttaattgtttgcttcagctttttagctgctgctttaataccagttgctaaaggatgatcggaatggtcttctaagctagccatcagtgctagaatatcatcttggtttaaatcgtcagcataactcttaactgcgttaaccgtgaatttaccttctgttaatgtaccagttttatccattaggacgtatttaacttttttagcttcttcaatcgattgacggttacgaactagtaaaccattggtggccgcaatactggtacttcgtgcaactactaatggaattgctagacctaaagcatgcggacaagcaataataaaaaccgtcaccattcgttcaaatgccacatccaagccttgtggtaaccaagccacaaacgcaatcacaccaacaactagagccgcatagaataaccatgaagctactttatcagccaaactttcagctttggatttagatttttgagcgtcactaactaacttcattacttgtgatagatagccactttcgccagttccagtaaccttaacttcgataactccgtctccgttaactgctccaccaattacttgactaccttcttttttatcgattaaacgtgcttcaccagttactaaagattcatttactttagttgaacctgaaactacgtcaccatcagttggaatttgttctcctgcaagtacgcggaccgtttggccaacttcaacatcgctcaaatccatatccatgacatgatctccatgtaaaacatgcgcttgactaggtaaaagtgcggccattttttcaactgcagagcctgcggccatcactgaattcatttctacccagtgccctagaagcataattacaattagtgttgcaagttcccaaaagaagtccattacatgaccgctaggattaatccattgattcattataaatgcataaagcgaatagccgtatgctacggtaattcccatcgcaattaaagtcatcattgcgggtgcttttgattttaactcactgactgccccagtcaaaaaaggcttacccccatagaagaataagaaggttgctaagattaagacaatataatcagaaccggtaaaactaatcggcaatttcaagtcgccaattctaaaatccattcccataaatggcgataataatagaattggaatagtagcaattaagcttacccaaaataattgttttagattccccatgtgcatcatatgtccatcgcccatgtcgtgcatatcatgttggtgtccactcatctcatgatgcatctgggaatgatccatttttgaatggtccatgtgctcttcattcatttgcttatgattcatgttacatatcctccatcttacaatccatatcacagtcttctggcaaacaattacagctcaccttatccggtgctgtttgtgccttttcctccaacttaccaattaacatttgaatgtcacttttagataattcaatttgatcaatcaaattagctaaagtagttcctaccttatgttggcaaagatggacaaaaagggatttagaagcattatccattgcaacttgttcttcaatcatgggctgataaataaattctcgcccatttttactggttcttaaagcccctttttttactaatcgccctaaataagttttagtggtggaagctttccatcccaacttctcttccaaaatttcgataatttgatgactcgtagccttttggagcgtccatattactcgcattgtttcccattctgattgactaatttcaatttcatcactggtattcaaactatatcctccaatctgtttacaaatgtaatctttaaatatagactacatttgtaaacttaaaaagtcaagaaaaaagacctcgatttccatcgggtcttaattaattaagatgaagttttaattttattctagattagttcttgagcgttgaatgataataatagctatgataactaatactgcaccgattaattctacgacgttaaaaggatggcctaggaatagtaaactcaacacaaaagtcacgaccggctggacagcatccaaaatacttacaacggcagatggggcaaatttcaaactgtgtaataaagcccagaaaggtaaaatagttcccactagaattaccgttgccattgaaagcattaactgtggtgtcagagctggtgtatctacccaaactggttgatgaatattaaataatatactaccgataattagtgcccatcctaaaacaatcattggaggatggtttttagttactggtttaggaagtacaacataaaatgcagctgtaattcctgaaagaattccccaaatcaatgctttattagaaatagctagttcatggatgtttccatgtgttattgccaagaaaacacctgccattgcgatcacgaaagcaatcacatcgcttcgcatcgggcgaacacgctgaaatactaagctccccaaaacaataaataaggggcttaaatactgaagaatggttgatgctgacgcattaccttcttgaacactaatatagaaagttaataaattagccattaaaccaaaaatagcatacgctaacaaccataaaacggttttaactgatttaaaaacatcaaaaatttgcatccgatacttaataaaactgataacaattaatactaaaccagcacctaatgttctagcagataaaaaccaggaagctggaatactctctccttgagaaatgacttccaataccgttccagaaattccccacatacaagacgctaaaagggcccaaaaaattcctttaccaatatgcttgttcaaaacttctttttccatcaaaaacctcacatacatttttctaatatatttaagtatacctaaaaagctataggccataaagtatattcgtgtcacatttcctaacaccgtgtatttttttgctaatataaaaaaacaggagtaatctcctgcttttattacattttgataattattcagttgttcccttaataatttcaaggattgagttgatgtgttctagagttttaacaaagtcgtcttttccgaatttgctagcaaccacatcaagcatttctctaaaaatacggtcattttcctcatataaatcgattcctttttgagttaatttgaggtatttttttcgacgatcttgtttatcattattttgttcgactaggccaaggtccaataaagttccaatttttcttgaaatggcactcttggtaacctcttgcgcatcagcgattgagctcaatgtaattgcttcaccatcagcttgcttaataaaatgcataatcatgaacatatcgaaagatacttgtggatctgacattttactttctaaaagcgtaccgattagttttatacttttgttatacgtttgagcaataaacgtaatatcagcttgtttcattttcttcctcccgattctagctttcccagccgtttacatagttaaatattaacagactcacagaacttgtcaacgcaaatattaattattgatgacatatcgtgttcttttgttcacttacttttaatgaatgaccctttaaaacgagtaattgttctactaatacttattttaaaacaattgtgaaggtaatatcaaattcatattaaaacgttttaacccttcatactaagaaactatgatactttacccatatcatagcttctgataatcctaatataatttacttacttgttcttggatagcatcatgatttaaaaactcatcataagttgtttcagcacgatcaaccgaacctttatcagaaacttcgataatatgatccgcaattgtttgaataaactcatgatcatgggaggtcatgataatagaactcttgtaactagtcaatccctcatttaatgcagtaattgattccaaatctaaatgattggtagggtcatctaggattaaaacattagccttgctcaacattgttttcgaaatcatgcagcggactttttctccaccagagagtttagtaacattttttagtacatcttcccctgagaaaagcatcttacctagaaaaccgcggagaaaagtattatcactttcttctttaggtgcatattggcgtagccattccaaaatatcaaaacgatcgtcttcaaaataactgttaatatcacgcggaatataactacgttcagtagtttgtccccaggttactgaaccgctatctggttccatttctccagctagaatctgcatcaagactgttgtagctaagtcattttgactcaaaattgctgccttctcaccagggcgaacggtgaaagtaatattatctagaattttcacaccatcaatcgacttgctaaccttgtccacccgaacaagatcattacctaattcgcgggctggttcaaaacgaataaaaggatatttacgtgaagaaggtttgatatcgtctaaagtaatcttatctaattgcttcttacgggaagtagcttgtttagattttgaagcattagcactaaaacgagcaacgaattcttgtaattctttgatttgttcttcttttttagcattagcattttcacgaagacgtttggctaaagcactagattccatccagaaatcatagttaccaacgaaaagttcaatcttaccaaagtcgacatcacacatcatcgtacaaaccgagtttaagaagtgacggtcatgggatacaacgattacggtatttggaaagtcagctaagaaatcttctaaccaactaattgattttggatcaagtccgttagtaggttcatctaaaatcaaaatgtctggttttccaaacaaagcttgtcccaaaagcactttaattcgttgaccttcggttaattcgctcatcttactgtcatgcagactttcgtcaatgcctagctgttgaagtaattgtgatgcttctgcttcagcattccaaccatccatttcagcaaattcagcctctaagttagcagctttcatcccatcttcttcagtaaaatccgctttagcatataaagcatccttagcttgcattacctcgtataactttttataaccttgaattacagtattcattacggtaaattcttcaaaagcataatggtcctgatttaaactcgacatccgttcattaggcgaaatactaacgttaccagaagttggttgaagtttaccttctaatatttttaaaaatgttgatttaccagcaccattagctccaataattccgtaacagttgccgggagtgaattttaaattaacatcgctatacaatttatggtcagagaattgcatgctcatatcatttacagttatcatttagttcctccattttgtagacaaaagaaaaagaggcaaaacaatgtcttgtcccaatttctaccagtctgtttaatttaacatacctactatccttgaacaaccttattgtttaggatatttaattaaaatggcttttatattttattaacacacaattttttagtccctctgcattaaagacaaagggctcactttaaccatttgtatgtcacccattagccataaaaacttttaattttttagctctattctgctgacaaagcttcgactgggtccaattttgaggccttacgggatggcgtaaaggccgccaatagactaataatgatactaatcgctattccaaaaatcagataacctggtgcgattccaataatcgcaaagtcgatatgcttcatagaaattacgttagctccccattgagctagcaatgcaaaagctgaacctaaaatacttgagaaaagccccaagaagaatgcttctgaaacaaagaggttacgtatatcctttcgacgcgcaccaatcgcccgaagaatcccaatttctttagttcgttcagaaacgctgatataaagtaccacaataatcataattgctgataccaatagcgagattcccgcaattccagctaacacatagaaggctaacatgatgtaagtattcaatgaatccagaattgcgcctaccccagtaattgtgtattgggggcgttctttacccttaacatcatgcttgtagttcttaattttattttgaacgctcttaacattctgagtgttattgacgttgactgtaaagaagttgggctggtaatccaagttcttatctttaaacatttctttcaacgtattatagtcaatcgcactcgttcccgaggtaattacccctgaaactgtaacttctttttggagttgaaccggttgttttttactatccacggtcgtcacgaaaactgtaattttcttacccacaacgtttttatactttttatcaaactttttagctgtagctttatctaacaggatttctccattactaggcttgctaccatatttaatatcaccttcacgttcggtcttattccatgtctgtaaaacttgcaaactaattgattttttaccagcgaccgtctttgcagattgaacatagtagccgcgttctactgatttaacattctttatcttattcattcgttggtaatctgtgtttgatagatctgctgtttcaccgttttccatttgttcttgggttacatttttagcaacttgaacagccgttggattgatttgtgatgaaatttggtcattcatataacccgtaactccatttcccaaacctaacattaaaataaccgagaaaatcccaatggatgccccaaaaatgattaacaggtttcgtttgagattgtagctcatatgtttcaaagccattcgtaacgaagcccagaacgtcaaatgtttagggaccaacgttttttcagcgtcagggactggataagccgcccttaaatcagcctcaccatgaattactccgtcatccaaatggaccactcgtgtaccaaaatcggctacttcttgcgaatgcgttacagcaataactagttttccatctttagcaatagattccaaaatttccaagacttctttagtattttgactatctaaagctcccgtaggttcatcagcaatgattacatcagggtctccagctaaggctcgcgcaattgccacccgttgtttttggccacccgagagttgattaggatgctttcgcatatgttctttcaagcctactcgttctagtaatgctttagcccgttctactcgtttagcatgagaaagtttcgtcatttccagagaaaccattacattatccaaaatgttcagatgactaatcaaattaaaactttggaagatgaatccgatattttctcttcgataagcatctaacaccttaggtttagccgagcgtaatgattgtccattatagacaatatcaccttcgtactggtgatctaatccaccaatgatattcatcagggttgatttaccaccaccggattcacctaaaattgaaacgaactcgcctcgatcaaattgcagattgattccttttaatactttaaattcttggttacctagaaaataggatttatgaacatcccgaacctctaataaactcatactttcctcctatatggtccttcagtgattatttggagtgaacttgttggaaatgtgttgggtagaaatatttctctacttccgtcacaatcaaaacaatgattccggctatcactggaattaaccattgtgcccatcccatggaagcagtgctaaagattgactgcatgaatggaacgtatgttaaagcaaattgtaacaccaataataccgcaattatccaaaaagcgtgtaagtttctcaaaatatctttggagaacgctggcttaggagtccgtagattaaatagatagaaaatcttaccaaatacaatggtattaaccgtcaccgtacttgccactacttcactaactccatggtcaattaaccaatcgtaaccaaaaattcctaatccggcgattaagatggaaacataaacaatttgaattacatcggctcgatttaagaaggatctgcccgctggacgtggatttctatccataatgccctcttcagcaggctcgaatagaaatgcaaattggattgtaatggcggataccatattaatccacaataattgggttgggactaatggtagatcttgttgcgctaggatagaaagtagaacaatcaacccttctgcaaaactggtcggtaacaagaaacgaatcgtctttttaatattatcgtatactcgacgaccttctttgattgccttagttaaggttgcaaagttatcatccgttagcaccatgtcagccgattctttggcaacgtctgtccccttcgttcccattgctatcccaatgtcagctcgttttaaagctggagcgtcatttacaccatccccggtcatcgccgtcactaaattattagcttggtaagcttttacgattcgtaacttatcattaggggtggttctcgcaaagacgttgtagtcttgaatgatattttttaactgttcatcatccatctcgttgatttcggcaccagtaattgcagcaatctggtcatccaagcccagtttttcagcaatcgcggaggccgtctcaggatgatcaccagtaatcatttttaccttaactcccgccttttgcatctcatgtaacgctacaatcgtttcttcacgtggtggatcaatcaatcccgcaattcctaagaactgcattccactctgtaaatcttcatgtacaatcgtttctttattatcttcaacttccttataggctactgcaactactcggtgccccttttgagctacttcagaaactttgttgtaccaatattgttcatcaaaggtagcatcatcgattgcggccattctaaaaatcttatctggcgaaccttttactaaaattcttcgctgcccttcaggactctgacttagttcagcaatgtaacggtaatcagagtcaaatggaattttatcgatttcttcccattgcggtacctgctgatgaaacgctttgttagctagggttaggaatgcaccatcagttggttccccgttaattacccaggtaccattttccttagacaagatcgtgtcgttagcttcatgcccagcaataattaacttccgtaaatcttcatgctgatggacatcaataacttggttattaaacctaatttcaccatgtggttgataaccggtccccgtaatttcataggttccttgcttggtaatgatttcttcaatcgtcatttcgttcttagtaagcgttccggttttatcagtagcgataacattaactgctcctaaggtttccacagatggaagagacttcatgatggcattttgttttgtcatcttccctactcccatcgctaaaacaaccgatgtactagcaggaagtccttccggtaaagaaccgacaatcatggtaattaaggcgattactaaaaccggtaacgaataaattttagtaacaaacccgtaaataccgactaagatcgctactacgataatcgcgtacgaaatatacttacctagtccattaatctcacgcattagtggagtagttttagagccaacctcttccacacttgaactaatctgtcctaattcggtatcggttgcggtcgctactacgatacccaatccactaccattggtcacggccgtcgacgtaaatgccatattagtctggtcacctagggtcgttttttctggcaatttgtctgtattctttaaaactgagtcagcttctccagttaaaattgattcctgaatttttaaattatcagcgtcgataattcgcaaatcagcaggaacattatcgccagcttctaggaaaacaacatctccaaccactaaattttcagcaggaatgtctgttctatgtccatcccgaataacagtcgcttcaatttgaagcatctgtttaattttgtcaattgcacttgaggcttttacctcttggaaatacccaattagggcattaataattaccaccattccaataacaatcgaatctgaatattctttcaaaacaaaggtggcaaccgcagctaaaatcaaaatatagataatactattattaaattgctttagaaaccggattaaattactttgctttttctcgatcaacgcgttgggcccgtactttttaagttgttcccctgcttctttttcggttaaaccgagttcagaattagtccccaaatcttgggcaaccttttcaaactcaatattataaaaattatcattgcgcgactgcgctccatagtcatcggatgtggattttactttcatcgatattctccttttaaaataaatttttgggttaactaaatcatatctaaaatgaataatacgcgtcaactaacttatctttttaataagaaataagtcttaaaaagaaccatttaatactttgcagtggcttgctgcaaaatttatttttcaaaaaaagccatgactttcaggccatgactttcaattttagttttaaattgtgcgttttctcatttttttctctaatgcccctaggactagatctgagataatcgccatcaacgcggttggtaaggccccggctaggataattgctccaccatttgtggcattagttccacgaataatgatatctcctaaacctccagctccaacgaacgttccgattgcggtaattccaattgccaagacaagtgcatttcgaattccggccagaatcaccgatagcgatagtggcagttcaatcatccaaagcacttgaaccttggtcattcccattcctttaccagcatctaagtaagcttcgtttacgttcaacattccggtataagtattcttaataatgggcaataatgcgtataagaataccgttacaattacagttgtaactcctaaaccaagacccaacattaaaatcgagagcattgctaaagatgggatggtttgaataacattagccagaccaacaatccagccactcaatttacgatgtttagaaataagaattccaattgggattcctacgatcgcagccaaaatcaccccataaattgaaattaaaaagtgacggctaaattcggaaagaacgtacatgccattatgagagaagtaataggctaattgttgccaaatattcatactttgcattagttattccctccttcaaaatagtggttcttttctaaaaattctttagcaaccactgatggttccttcagattattatcaacttgatagtttaattcttgcatggtctgcaatgaaatttttccatctaatttatgaagaacccgcttcaattccggatatttcttcaatgatttattattcacaaccacacttgcattatatggtgggaagtaatttttatcatctttcaacaattttaaattgtagctacggattcttccgtctgttgagtaacccagaaccgcatccattttatgactagcaagagcattataaactaacccaatttgcatgggataaatattaccaaagctataaccgtaacgttttttaaaatctgcgtatccgtcacccttacgacttagccaagtttggtcaattccgactttcatatctgccgaaattttcttaagatcattaacattttctagatgatgttttttggcataatcttgcgtcaccataaattggaaagtatccgcaaatccgtaggttgggaaataagtcatatcatagcgccgattaaattcttttttaacataggcattcacttgttctggagtgcgcccttggggtccattcaaaatagtctggtaatccgttccactaaaacgaacagccgttaggtcagcttccccacgtttttgagcttgaaaactaaccgttcccgatcccaagttattgataatctctgcattcaagttagtatcatgttcaatcaattgttgaataactgaagacattacctgttgttcagtagtattttgggcagcaattttaactgtatttccagtcgtaccaccaagtcctggccagccacaaccggaaagaactacagctaatgcgcccaacggcaaaattaatttaagaaatctttttaacatttagcccacctcccgtgttcgaggggttaatttgtcttccaattttccaagtaataaatcggcgactaaagctaaaataatcacagggattgatcccgctaagattaaatccggacgatatagatttaaaccgttgaaaatcaaatcacccaaaccgccagcaccgatataagatgccaaagcagtccatgcgattacataagtagctgataaacgaattccagacataattactggtaatgctagttgcaattcaactttccacaatcgttgaaaactattcattcccatccctttagcagcatccactaacgctggatctacactatctaatcccagatacgtgtttcttaaaataggaagtaatgagtatataaataacgccacgatggctggagttgacccaattccaaaaatcggaatcatcattgcaagcaaggctagcgcaggaatagtttgcatcacactggctaaaccaataacaaaaccagagatcttaggtgcccgaattaaaagcatccccaaaggtaccgccacaattatccccagcgctaaagcaaaagctgaaatataaatatgttgtcccgttttacttaagatgtcgcctccatattgattcaggaagttgatcattattgatcaccatctttctctttttgctcctccgattttgaactagcatcggtactgctatctgtagtgattccatcatctgtaaataaagcatcatacacaatatcaaccaaggttgctcgggtaacaattccaactagtttacgatcattatcaaccactggaacgttacgaagtccccgtttcaaaattcggtcaaccgtatcacgaataattgaattttcatttacatagaaaacatttggatccataatttcgcctacagttttaccagaatggtaatactcattaatcttttcaatgcttacaactcctttaagatgttgttctgcatcggttactaataaagtatcaacccgtcgactgtgcataatatcaagggcccgaactacaggttggtcaatcgcaattgaaactggcttattagccacttgcccaacggtcgtaatacttggtttagcttgaatcaaacgatcttgtccaatcaaattagccacgaaatcatttgctggttttcgtaaaatattttctggtgtatcaacttgaacctgcttaccaccagtcataaccactattcgacttgataaacgtagtgcttcgtccatatcatgcgttacgaaaataaatgtcttgcctagacgttcttgaagatctttcactaagtcttgtaaatcttcacgggtgataggatcaagggcaccaaaaggctcatccatcaaaatgatatcctggtcagctgctagtgcacgaacaaccccgattcgttgttgttgtccaccagaaagctgggaaggatagcgatctaagaagtcctctggtaaatctaccaatttaatcatttctttagcgcgttcgttacgcttttcttcagaccattttaatagtttaggtactaatgttatgttttcacgaattgtcatatgaggcatcaacccaatattctgaattacgtaaccaatctttcgccgaagtttaactgggtccattttggcaatatcttgcccattaatcttaatggttccagagctctgcttaagcatccgattgatcattcgcatcgtggttgttttaccagaaccggacgtaccaataaaacagatgaactctcccttttctacatccagattaaagtcgtcaacgaccactttatttccaggataaactttcgaaagatggctcatttcaagtaacatttgtatttaaacatctccttattaaatcttgcaatcctctttaaagtgtttaaagaattacaagttgttgaccgcaactataacatacctagaaaaaaaatgcacaaaatcaagcttttatccttgccattgtaaccgacttctttcctattattaaagcttattaaacttgtgaaaaccaatagatgttgtaagatagtagtataaattaaaaggagctgattaaatggcaaaatatgatacattacttccacgttttcttaaatatgtaaaggtaaacactcgttcaaatccaaattctgaaacagttccaacagatccaaaagaagttgaatttttaaaaactttagctaaagaattagaagaagttggcgttgttgatattcacacacaagaatctggttacgtcgttggtacacttcctgccaatgatggtggtaacacaccagttattggttacatttctcacgttgatacagctgactttaatgctgaaaatatccaaccacaagttcacgaaaattatgatggtaaatctgacattgaccttagtggtgatggcgaatgggtacttagtcctactgttttcccaagcttaaacaaatatgaaggtcatgatttagtgacaactaacggactcactctactaggggccgatgacaagtctggggtggccgacattatgactatgttggactactacaaggctcatcctgaagtaaaacatggtgaaatccggattggttttgctcctgatgaagaaactggtactggggccgaccattttgatgcaaaagattttaatactaaatatgcttatacagtagatggtggtccacttggcgaacttgaatatgaaacattcaatgctgctcaagctataattgaaattcaaggtaacgaagttcatacagccgttgctaagggattgatggttaatgcactccaagttggtattgattatcacaccatgcttcctgaacatgatcgtccagaagaaactgaaggacgtgaaggcttctatcatctatttaagatgacgggaactcctgaccatgcacaattggtttacattattcgtgatcatgatcgtaagatctttgaagaacgtaaacaaaagatgcaagaaattggtgacaagttaaataaacaactcggtcaagaacgggtaaaagttgaagttcacgaccaatactacaacatgcgtgaagttcttgaaaaagatatgacaccagttaaaattgcacaaaaggctatggaaaacctcgatatcaagccagatatctatcctgtacgtggtggtacagatggttcaaagatttcatttatgggcattccaactcctaacctctttgctggtggcgaaaacatgcacagtcgttacgaatacgtttctgttcaaactatggaacgtgccgttgatctcttgcttgaaattaaccgtctaaactcagaagaaaataactaattttttaaggactgtgacaacctagttgtgcagcccttttttaataaaaaggagcttacttacggcacttacaatggctataatcggatttggtaaaagcgctaatcgctatcacattccgtatattaaagaacgcgatattaaaattaaatatatctataatcaccgtcgtcatcgcgaaaaagaacaaggcttttatgacgctgacacgattttcactgataagcttgaccaagttctaaatgattctgaagttcaattaattaccatttgtaccccacccgcaactcattttgaatatggtaagttggttttggaacatggtaaaaacgttctgattgaaaagccttttgtagctaatcaaggcgaagctaaagaactctttgcattagcccagtctaaaaaattgctagcaatgccttaccaaaatcgtcgttttgatagtgactatttgactctcaaaaaagtcattgaacttgggtacgttggtaaacttttgtcactcgaatcacattttgacaaatatcgtcctgataaccgcctccatgaaggatctcaggttgatggccaattttatggtctaggggtccacatgctggaccaaattttaggactctttgggaaacctcaaactgttagctacgatattcgagctatccaaaattcagctagtacagtagacgatttttacgaaactcaattgttctatgataactttaaagcaacggtcgttagcaaccccctagcagcgcgtccctatccgcgtttcttattacatgggactaacggaacgtatgttaaatacgatattgatcaacaagaaaacgacttaaaattaggcattatgcctggagatcctaatttcggcattgatactccgagtcaatttggcgtggttaaatataaaaaccaaaatggggattggattgagaaacaaatccctactataaatggtgattatggtcgggtctacgactccatcgctaaaacgttaactaatcgggatgtgaaactcgtttctgatgagcaggccctttggaatatggaaattctagaagccggtatcgctgaaaaagggcctcatctttataatttgaaataaaaaaaaaccattaaacgataaatgtttcgtttaatggtttttactttacattatttccaacgtaaatttttcatcgcagcgcttttacccggctgctaccttaaattgttcattaacatatttagcatacatttggtgtgaatcaaccaattcttgatgggttcctgagccagtaatttggccattttctacaaaataaatttggtcactatccacaattgtggataaacgatgcgcaattactaatgttgttcggcctttcattaggtttgccaacgcgtcttgaactttcatttcggactctgaatctaaactagctgttgcttcatctagcattaaaattttaggattacgtaggaacgctctagcaattgcaattccctgtcgttgtcctcctgaaattttaacacctcgttctcccacctctgtatccaattgtttaggcatttcttccacaaatttcttagcaaaagctaattcaagtaccttccacaattggctatcttcaaaggtatcgtctaacccataagtcaaattatctcgaatggtacctgccatcatcgctgaatcttgtgacacaaacccaatttgttggcgataattagtcagctggatatcttgaatgttggtccgtatcaggttatgctgacaaatttgtccaaaaattcggattaaatttgcaatctaccacattagtattgctactcgtgaacctgtttcaagtggaattacaccagttgatattaagagtgttattaagcaaagaactcgctgggctcgaggagttattcagagttgcagaaacatgcatatctttactaatccgaagattaccctacttaaccgaattattttgattaatacatggctctattggtggtcattttctagacggttaatttatattgcagctccgttattgtatgcattattcaaggttcaagttgttaatgctaatttctggattttaatgattgtttgggccccaggatacttcttattgcattttgttttgggagatacttccagcaatattagaaacgaacgctggggggaaatccaagaaactttctttgctccatatttgtttattccagttattttggaatcaattgggatcaaagctaagaaatttaaggtgacagataaaaatgttaagttctcgattgtggataaactctacattattccatattttattatgtgggctttaaccttattggcgattgtgaagttcaattatggaaaatggggatcagaaatcattgtcggaagtgttatcactttctggttagtaatgcactttattaacctaagcttctgtttatttatttctatgaaacgtgatatcaatcgtaaaagtgagcggtttgttcggcatgctaaaggtaaaattatggtgaatggtgaatgggctaaatttaaaacccgtgatgtttcagatggtggtttttcatttgaatttgttaataaggacttacgtctaaaaatgaacgatcaagtcgaaggaattatttaccacgaaaactttccgattaagtttaaatgtactgttgctcgagcggtagatacggaaccgatttggtatggggtggtagtcaaaattgacaagaaagaagatcaagatcattatctccagttaatttatgatggagagaatcaattcttatcaaaagagcaagatcactggatgacgccttttgatgaacttcatttaaatgtcattctaagaatgaaagaattagaaagaaatgctactcaatttatgagacaacgataattagtttaagaaattgtaggtgtattttatgtcaatatcgggattaatcgtcttcatcatggcccaaattggatatactgggatggttcgcatggcaggtgtgaataaatacatgtcctggattacatcgatggtaattcaaacgttgctattgtatgttttggcgatgctaaattggttaaaatttggactaaaagcagtcgttattttaggctgcatttttgtagtagttcgaattggatcaattattttccgagtgggaaagctaccttttgaaggtatccattattttgatgtttggatgattgttatcggaattattatgggacgcatcttatttgccagcccattgattcactatgataattattcacattgggcattaatcataaaatacctcctatttcaaggtcatttgccagttgcggcagataccattatttcgtttacttcttatccaccggcgacggctttattcattacccagtttgtatcatgggtaggttttagtgatggtgctatgttactaggacagtttttattgatttgggccagtatctacgggatatttgcggttttacgggatcgaactcgttcaaccaactcatttataatctgttttgctgtttcaattattaatatttttaatatttcaattcgaatgaataatttattagttgattttgtccttccagtagtcgccgccgcaggatttgcgggagtttatgcttaccgtcgctcgccttggttgcagtgtgctacagcgtctttatttagtgcggaacttttactgattaagaattctggaacgatgtatgtagtgatgctaggctgttatttgttgtattctttagttaccaatggacaaggtcaacgctggaaacgcctgggtaaaggcatcagccaaaccgtcgtgacaatgggactaggctatttaccattcttctggtggaatcagcatgtgcatgcaactttcagcgctgtgtcaaaacatcaaattagtacagatgcgtacaagagtcagttagcccatgaaagttcagccgtaattgctaaaattggaagtaaatttttacatcagattttgagttttaactcgctatcgacgcgtggagtattacttattaacgtcggtctactcggagcttggattattattcgctggtttttacgtaaaaagaataacctgctaaaaagtttaatagctattgatatcagttttagcgcctattacatcagtgtatttgcgatgtatattgtttcaatgccctatgcagaagcaatcctgttagatggatctgaacgctatctttcaagtatggtgattctaaacctgctattagcgaccatggtgctggttgtagcgatggaccgagctagttttgaagaagatgttagtaaacgaggaatccgatctttcaggaatgttattaccaaaaatgtttatcagttgtcatcattggttttaatgttgtttgcctccattttgatgttttctgaaattaacggagttaagtataataacaccttaggtaaagaacaattgccggtacaattaaaacaaatagctcagcagagtacccagtacaatcatcagaaaattctattagttgacccacattttaatgatgtaaataattattacgcgggttatgtgggacgctattatttcttttccgatcaagttgttggacaggaaaacttcatgatgtctcaagcggagttcaaaaacaccattaaacagtatgattatgtggtgttacctgaatggcatcgaacatttacgaccatgctggaaaaaacgtaccatcaggattataaaacggggttatttaaagtcaccaaagatggtttacaaaaagtaaataaaattaatgtttaagagtaagctgaaaatgacaagtgaattgtgattttcagcttttttagtactttaagtataataataggaatagaagtagattaataatagaattaagcgtggtgaaaaaatgaaacgaagggataaaattcagcggattatcttatttgcgctgattacaagcggtttgagttggtgggtggtatctttcctacccgatgtttttacgttcaactggtggattgtaggagcggttaatgctctgtatgttttttatgtgtcagggggatgaaaacaaactatgggtgacaaaacctagagttgcgaagcatgataaatccacattgcaacaatcttggttcaaatttttggatttttccagactaacataaactaaaaaattcaggtagaggatacaaggttgatgtgtataaattattttatctatgaagacaattcagtataaggaaatagtgaaataattagccttaaaaccgaatcttagttgccactcttattaattaatatggtatagtagttatggtttttgaaaagagcgctccgttagaaaaataaaaactaacaattcattggtggattgatccatttttttgctttcttataaaaatggatcaattttatggtggagagtttatttcaagttaccgaatttctaaaccaatagaaaagagggactcaatatgtcagaaaaacttgatgaagtagatagtaagagcctggacgagattaatggtagtatcaaggtacctaagaatgcaggcttttggaagacgctgatggcgtactccggacccggatttttaattgcggttggttatatggatccaggtaactggattacgtcaattgcgggtggggcgcaatttagatatacgctcctttcagttattttactttctagtttaatcgcgatgcttttacaggcaatgtcagcgagactaggaattgtaactggaaaagatttagcgcagttaacgcgggaacgaacgagtaaaagagttggattcttgctgtggattgtcgctgaattagcgattatggctacagatattgccgaaattattggatctggaattgcattggagctgttattccatattccattaattattggtattttgattacagcggcagatgttttgatattgctgctattaatgaagctcggttttagaaaaatcgaagcaattgttgcaaccttagttgctgttattttaattgtttttgcgtacgaagtactgctttctgatccaagtatttcagggattatcaaagggtatgtaccttcagttgagattttaggtaataactcaatgttgtatctgtcactaggaattgtcggtgcgacagttatgccccatgatttgtatctgggttcttcaatttcacaaactcgtgaagtggaccgaaaagatcgggaaaatgtcgctcaagcaattcgtttttcaacgattgactctaatatgcaactattcttagctttcattgttaatagtttactattgattttgggagcggccttattctatggaacggatagttcactaggacgtttcgttgatttgtttaatgctttaagtaataaccaaattgttggggccattgctagcccagtacttagtatgctatttgctgtagccttacttgcttctggacaaagctcaacaattaccggaacattatctggtcagattatcatggaaggattcattcgactacgtgtcccattgtgggtacaacgtttggtgactcgagttctttctgtggcaccagttttgatttttgccatttattaccacggtgatgaagctaaaattgaaaacttactaacgttctcgcaagtattcttaagtgtggctttaccgtttgcggtaattcctctggttatatatacaagcagtaaaaagttgatgggtgaatttgctaatcgagcatgggtaaaatggtgtgcttggactgcaacaattgtcttgattttgttaaatatatatttaatccttcaaacgctaggtttaatcaaataagtcttgatatataagcgtttaattaacttaaattgaacttcaaaatttgtttcaaagatactcatttctaaacgaaatgggtatttttttatcttatggtgtaaactaaaaatataaaaaataactgtctaggtattggtgtgaaaaaatggaaacaaaaaagataacgattaaagatgttgctagacaatcaggagtttcaatctcgacggtttcgcaaatcttaaatggaaatgaagctcggtttagtgcacttacggtaaaaaaggtaattcaggcaaaaaaagatttaaattatgagcccgattactttgctcgtcgaatgattatgaaaaaaagtaaaacgattggtgttttagtacccgatattaccaatccattttttagtgaattagttcgtggaattgaaaatattttttatcaaaagggatttataactatgctttgtaacgcagatcttgaccaggaaaaagaagatgcttacttagctgaattgagtcggcgtggggttgatgggtttattattgctagttcagtaatttcaaatgaatctattaatgccaccttaaaagctaaaaatcatccatttattgttcttgatcagaaaaaggctgatggaattagtgacgccgttttaactgatgatttttcgggtggggctcaagccgctcaacatttgaaagatttagggcatcaaaaaattgccatagtcatgccaactaatgcacctgaaaatgtttgtggtcgtttagctggagtacgttctgtatatgaagaaaaacaaattgaaattatcgatgcccagctatcaaaaattggtggtcgggaagccgttgctaaaattttagcaacggatgttaccggaatatttgcggtcaatgacgaaattgccttaggaatttatttgggattagccgaagctggcaagcagattcctgaagattatagtgtgattggctacgataatattgatatgtgtgaatatatggttcctaaactgaccactattgcacaacctatttttgagttaggtcagacaacagctaacatgctgcttgaaagaattgaaactcctgataagaactgggaagagaagactttacccgttcacttagtgaaaagattttccacagcacatttgatttaatagaatcaatgtgctatatttttgatatgctattaaaacgttttcataaaacgttttaaacaagtaaaaagataatcgaaaacggaggaatccatcatgaacactgtaacaattattgggagcattaacttagaccgtactatccgagtaaaacaaatgccaaaaccaggtgaaaccatgcatacgaaagaaattttttcagctggtggcggaaagggagctaaccaagctgtagctgctaagcgttctgaagctaagacaaactttattggtgcagttggtaatgacgacgctggccgtgcaatgttagaattattggaacatgaaaatattgatatgagtggaattgaaactttagataaccaatctacaggacaagcatacatagtagtagatgacgctggtgaaaatcaaatcatgattcatgcgggtgctaatactgcatttactccagaatatgtccagtctaaagctgatttaatcaaaaatagtgatttcattattgctcaatttgaaagttctttagattcagttacggaagcctttaagattgctcgtgaagcaggcgttaaaacaatcttgaatcctgctccagcggttgaaaaagttcctagtgatttattagcagtaacggatatgatcattcctaatgaaactgaaactgaaattttaaccggaatcgaagtaacagatgaagcaagtatgaagaaagcttctaaagtattacatgatgaaggaattgaagcagttttgattaccattggtagcaaaggaaccttctacgatgttaatggtaaaagtggaattatccccgcatttaaggtaaaggctgttgatacaacttctgctggagatacattcattggagcaatgagcaccgttttgaataaagactttagtaacttagaagatgccatcctatatggtaataaagcttcatccctaactgtacaacgctttggtgcacaaccatcaatcccttacaaaaaagaattggaaaaataggaggaaataacaatgaagaaaactaaaatgattaactcagatatgtcacgggtaattgctcaaatgggtcactttgataaattaagtatcggtgatgctggaatgcctgttccaatgggcacagaaaagattgatttggcagtagataatggaattcctagtttcatgcaagttttaactaacgttttagaagaacttgaagttcaaagaatttatctagcagaagaaattaagaccgaaaatcctaagatgctagaaaatattaaagctttaatgcctgaaacaccaattacttttatgccacattcagatatgaaacaagatttgaataattgccacgcatttgttcgtactggtgaaatgactccttattctaatattattttagaaagtggcgttgtattttaaatttagcaatttcgtcaattaattaaggaggaattacatgaacacgacagcgttattaatcggacttggaccactattaggttggggattatttccaacaattgcatctaaattcggtggacgtccggtaaatcagattgtaggtacagcttttggaacatttatctttgcttttgtttttgctctaatcaaaggattagccttaccaactggaatggacttggtttttaccgttatttcagggattggttgggccagcgctcaaattattacatttaagtgctttgcaatgattggatcttcacgggccatgcctattactaccgctttccaactgttaggtgcttcattttggggtgtgattgctctaggaaattggcctggagttacggctaaaattattggtgcagttgcgctagtcttgattattattggtgcttcactcacggtctggtcagaacataagtctaaagaaaatacccaattgattactaaagcagtcgcttggttggctgtaggtgaaattggttattgggcatattctgccgctcctcaagctacatcagtcgatggaatgcatgcattcttacctcaagcaattggtatggtaatcgttggtgtagtatatgcaatcttcctctcaatgcgaggtgaaaaatcagcattaactgaagcagtatcttaccgccaaatctggtctggtttcttctttgcttttgctgcactcacatatttaatttcagctcaaccaaacatgaacggcttggccactggatttattctttcacaaacttcagtggttctagctaccttaactggaatttggttcttaggtcaaaagaagacgccaaaagaaatggcagtaaccattggtggattagtattaatcttagttgctgcaacaattacagtaatgatttaataaaaaataatttgttttaaaaagtttgcaacacgttctgatattaggaacgtgttttttgtattcactcgaattagtccaaaaagaaacagcatttcacagttgaaatgctgtttctttttatgcgtgctgttcgtttttctgaataaataatttccaaaaaagataagccaaactccatattaatatgaacccaattaccagaccatagcccagccaatttaaatcaatcgattgaatccatgtgatgaaactagaattaacgtgggtaaagtcagcaaagacgttgcctaactcgactaaaccaattaagaaagctgcaatgactgaaacaaaagtaacggttaaattgtagtaagccttacgtttaggagtatcaaatgcccatgtgtaggcacctgacatcatcacggaatcggttgtatccatcacgttcattccagcggcaaataaaactgggagggcgatgattccggctaccgatacgtttgattgagcagccgttgccgacagtgcaatcaaggcaatttcagtggcggtgtcaaagcctaaaccaaataggaatccaattggatacatctgccaagcatgaacgattttcttgaataaaggagaaactaagttagcaataaaacctctagatagcagtaaatcgtttaattcttgttcatcaagaccggattttactaatctcagtgatttataaagtttgattaagaccattaaattaaaaaaggcgattaaaataagaaaactaccggatacaatcgtaccgatttttccaccaatggcttctagaatgggtagcttaacttgggcccatttagcagaaatactaacgactaaagccattagaaatacaacagtagagtggcctaatgagaagaaaaatccgactccataaggttgcttcttttggtgaattaataaacgaacggtattatctatcgcggctatatgatcggcatcaaaggcatgacgtagccccagggtgtaagctagcacacctaaccccagaaaactaggatgtttttgggcagcaactaacagtaagataatgcccaaaatatggatagccaagctagctgtgtaatacggaagtgctccataaaataatttcttcttcataacgatatttctcctaacttttaaatcgtaaattcacgtaaatagttttcatcataaataaaaattttctgattcttgatatcaattacgtgttgttcttttaaatcatgaataattcgattaacgctgtttctagttgaaatcccacagaaattggcaatttcttcgttagtaatgggaaaatcaatcaagataccagtcgctccacgcctaccaaaaatatcaattaacttatagataaaggcgcagacggcacctttcttaccgttcatagtcatccattgtaacgattttatattttgggttaatttaattcgatagtagtcacgcacgtaatcttgtaaatgagtatcgtgattaacataatcccaaaatgttttacgcgggatgcgataaaaaatagcttcgtcagattcaatacgcacgttcaaaggcgaagccgtataggcagaaatttcatctctcaaaagcgaaacaatatcagtcgaatttatgtaagaaagattaaattcacgaccattctttaaaatgatgctggttttgacaattccctttttcaagacatatgtataaccttcttctaaaccatgataggtcagataggaatgttttgttttggtaattgtagaaacctgtttattctctaaaaagtcaattaaatagctagtgttcattttttaactctccatatgtctaaaagtaaataatatgtacagacatctattatcataagaaaaaattgtgagaagtgtaacaaatgttatacccaaatgtgatacccggtcgattttacatagcctaatatattgtctagcgccaaaaataagggagtgtgtattaagttatggtacaaattgacctaccgtacgataaaagaaatattactgctaatattccagacaaaaattttgctggattattagaatctaaagctgaaagtttccagaatccgttaagtgaaaaggaaactgttgaaaaatcaatggacaatcccattggaagtcccagcttagaagaacttgcaaagggaaagaagaacattgttcttattagttctgatcatactcgaccagtaccttcgcatataattacacctattattttacgtcgaatccgttcggtagctccagatgcaagaattcgtattctcgtggcaaccggttttcatcgtccatctactaaagaagaacttattaataaatatggttcagaaattgtagagaacgaagaaatcgtaatgcatttttcaacagacgatgattcaatggtaaaaattgggcaactaccttctggtggggattgcattatcaataaagtcgctgctgaagccgatttgttactagcagaaggatttattgaatctcacttttttgctggtttctctggtggtagaaaagctgttttacctggtattgcatcatataaaacaattatggctaaccactctggcgaatttattaactctaataaagcccgtacgggtaatttaatgcataacccaattcataaggatatggtttatgcagctcgcaccgcaaaattggctttcattgtcaacgttgttttagatggtgataagaaaatcatcggttcatttgcaggtgatgttgaagcagctcataaagttggttgtgattttgttaaagaattagctagtgttaagaaggttcctagcgatattgctatttcaaccaatggtggttttccccttgatcaaaatatctatcaagccgtaaagggaatgaccgctgctgaagcaactaataaagaaggcggcgtaatcattatggttgccggctctagtgatggacatggtggagaaggtttctatcataatttagctgatgtagacgatccaaaagaatttttagatcaagcaattaacacaccaagattagaaactgttcctgatcaatggacttcacaaattttagcacgtattttggttcatcatcatgttatttatgtttctgatttggtagatcctgaattaatccgcagtatgcacatggatttagcaacaacatttgatgaagcattgcaaaaagcctttgaaattgaaggcagtgaagctaaagtaaccgttattcgtgatggattatcggtaatcgttgaataatagactaagaggctaaacaaagatgaatgtaactaaaatactacaatccgttaaaaacgaagaactatcaatatcagaagcagctaagcaattatctgggttttctgaactcggttttgccaaagtggatacacaacgtaaagcccgaaacggctatccagaagtaatctacggggaaggcaaaacggttgagcaaattgtagcgataaccgaagatcttttaaccgaaggcaaggcaattctatcgacgcgagtttctgctgaaaaagcggtagttttagagcagaaatttcctgacggaatctatcataaagacgcgcggtgttttgttttaaatccatctagcaaattaacagatggatatattgctattgtaactgcgggtacttctgatattggagtggccgaagaggcagctatcacagctgaaacttttggcaattctgtcaagcgaatctatgacgttggtgtcgctggaattcatcggttatttgctaacttagacgacatcaaaaatgcttcagtagttattgtgattgctggaatggaaggtgctttagtcagcgtagtcggtggcttagtggacaagccggtaattgcggttcccaccagtgtaggttatggaactaacttagacggaattacggcgttatttagcatgttgaatagttgttcatctggggtaagtgttgtcaacattgataatggttttggggcagcttataacgctagcattatcaataaaatcagagaaggagaataatttttatgcgagctttatatttagaaccattctctggtctaagtggagatatgcttaatggacttcttttggatcttgggggtaaattagatttattaaaggaagaattaagtaaatttacgcttgaagactatacaattcaagttgaaagaactaataaaagtagtatttttggaatggattttgatgttcaaattgctcaccagcataaagatactggaataaaaggcgattttgaccaccacgaccaccatgaacattcacaccacggtcatcatcaccatcatcatgaaagtcgtggattgactgaaattctgggcttgattgaaagtagtgatctttctgacgtagtcaaaaagcacagcagcaatgttttcaaagatattgctaaagcggaagcggctgtacataatgcggatgttaataaaatccattttcatgaaattggagctgtggactcgattgtagatatcattagtttcttcattctttgggagcaatcgaaaatagataaggtttattcgacaccgattactgaagggagtggcacgattcacgttgcacatggagaaatgccagttccagttccagcagtaatgcaattacgcaaaaattatccattaaaaatcgttcaagattttgatattaaaacggaattggtaactcctacgggattagctttgtttaaagaaatcgctccagaatttacggccccagaaaacatgtactttagtcaggtgggttatggttttggaaagcgagaaacaggaaaatttaatgccttacggggttcattgctaactgtggaacacagtaatcaggaagtaaaaactaatcatgacgacatcatcaaaattgaagctaatttagacgatcaaactccagagcaaattggatatgctatggatattttgttagaacatggagctctagacgttttttgttcatcaatccagatgaagaaaaatcggccagctattttgctaaatgttttggtgaaacctgaagcctttgacgaaatcagttatttaattttcaagcataccaatacagcaggttttcgttatcagggcatgcaacgtcggattatgaaaagagaatttaaagaagttcaattcgaaaatgaaaatttacgaattaaaaaatatcaatatcaagatattgaaaaatttaaaccagaatttgatgactgcgaaaaaatagcaactaaaaatgattggtcattacaagcaacatataaaaaaatacagaatttatattaagtagataacaaaggagtttaatttaatggtaaatcatctattagccgaatttatgggaacagcccttatgataatttttggtgtgggagttcattgtgacgaagttttaaagaagactaaatatgccggttcaggtcacttatttgcaattacaacttgggcatttggtatttcagttgtgttatttatttttggtggcgtatgtattaaccctgctatggcacttactcaagcaattttaggtatgattccttggaattactttattccttatacaatcgccgaagtattgggtggtgtagttggagcagtgatcgtttacattatgtatgctgatcactttaaagaatcagaaggttcaattgatccaatcgcaattagaaatattttctcaactaatcctaacttacgtaatttaccacgtaactattttgttgaaacattcgctacattcgttttcctaacatcaattctagcaatcgttcatggttacgattcaatgtcaccaatagccgtgggactcttagtatgggccattggtatgggacttggaggtacaacaggattcgcgatgaaccaagctcgtgacttgggaccgcgcttagcattccaattacttcctattaaaaataaagctaataatgattggcaatatggtctaattgttccaggaactgcaccatttgttggttcaattttggcagcagcttttgttagattttacttacacatttactaaaaaaatcgataattaaaggagaaacattattatgactgacttagaagcaaaagaaaataatttaattaaggatttagcatcaaagcaaagagttgcaatcgcttattcaggcggaattgatagtacatacttacttaaagtggctgtagacgaattaggaaaagacaatgtgttagctatggtagttaactcagaattgttcttggatgatgaatacaagaaggctttggaattggctaaggaccttggtgcaaacgcaatgggagttagcatgagtgaattagctgatgaaagaattgcagctaacacaccagaaagctggtattacagtaagcaattgttatacagaactattaaaaaggcagcagcagaaaaaggctttgatatcgtgcttgacggaatgatcatggatgataacgctgatttccgtcctggtatgaaggctcgtacagaagaaggcatcgtaagttcactacaagatgctgacttatacaagagtgaaattcgtgaacttgctaaagatcgtggaatttccaactggaacaaggtagcttcatgtagtgttgcttcacgtttcccatatggtacaaagcttactgcagaagccgtaaacaacgtatttgctggagaaaaatggctacgtaacgctgggtttccagttgttcgtgttcgtgtgcacaatgatttagtacgagttgaagttccagaagtagaatttgccaaattattagctaagaaggctgaaatgtcagaattcatgaaaggattgggcttcaactacgttactcttgatgtagatggtttcaagtctggtcgcatgaatgatgttttaaaagaagaaaaaaaggccactttaatctaatttgataaaggaaaaatacgatgtttaaatatttaatcacccagcttcaaaatgctagtaaagttatttacgatggaagtcaatgtcgagtatttttaatgcaagcttatcaagaaagcattgcaatccgacctaatctaaaatctgaacaagaactagcattaattaatcgtttttatgaattaaatagagaactgattgagctttcagataatcgctttaacaccaagcaattagaatatagaaaagtgatcgatgaattgatcagtgccatgcaagctgcataagatgaccgaaaaagacgcttctaaattaaaattagaagcgtctttttgattttatggattatttatttttaaaacgtaactcatagctaagtaacattacgactgtaattgctaggatatacaagggtaagattccaatccatccggtatgaaatgcactaattagataggtgaagaaactgatacaaatatagtacccaaaactaaagataccactagctaccccaatcacgtcttcgtaaccaacgagtgctaaattaagcgccattggaagtgtaatatacaaaccaaaaaagacgataaaaatacataaaataaagaggtaaatatttccaatccaactggcacccactaataggaaggctccaaacatggctaggattaatccccatttggtaatttgaatggcgctaatcttggcgactaggtgattaatggttatagaaccgaaaatactagataaggcaatcactactcctaaaacaccatattggatagaactaagatgaaaatgttccatgaagataaaaggtgcttcagcatagaaactgaagagaatgccattaattccactaattagtaagccgtaaacccaaacgtttggatcagttaaaagacgcataacaataggcttgaacgccggttgacgagtaacattagacaattggatattagtttctggtagtcgtcggagtgtatatagatataaactaactgccataacaattaagacagaaaatacattacgataaccaaaataagtctgagtaactccgcctaataatggtcccattgcaggggagagggctaaggcagccccaactttagcgaatactttcgccccggttgtaccagcaaaggattcgcgcatgatggattgcgttacgacagaaccgacgctggcaccaaaggattggaccaatcgaaatagaattaggattgcaaaattaggagcacacagtaatccaatgttaccggctaggtaaacgattagtcctgctaacatcgctggacgccgaccgacacggtcagagtaactaccccagaataaaacacctagggcaaaagcgatgaaataagaactcatggttaattgccccgtctgagcagtaacctgcagagccgaacttaaagctggtaaggcaggggtaaagatggactcactaatttgtggaaaaccaaccagaaggataattaatagtaaagatggaacttgttttcggacgtttttcattttaaatctccttaaattttattatgcagaaaaacgccctaatttaattacggtagcagatgcgataaaaccaacgtaggccaaatagactcctccttttcaaaatttgatttaattattgtaacaagttaaatttatttttccaaatttagttcaaaggctaaacgtcgaccatcttcggtagggttaacatagataataccggtgtattcaaaattaaattgttgaacaaggtgttgcattcgctgatttagttcgtgcgtatcaatccggaaattattaatctcggcgtgcgttcctaaggtgattaaattggataggaagaacttgctgagagacattccgcggtagtcaggtgaaatagcaattcggtgaatagtagcatatggcgcactagtatttttccattgaccgtctgaaatattttcgtagttggcatccggggtggtcagtaaagtggcggtacctgcaatttgattatcgactttcagtacccaacaatttccatgattaatgtcatcggcgaaagtagtttcgtcgggacttccatcttgccattgagggctcccatccgctttcaataaagctttggcgttatcaataattttcataatggcaggtaaatcttgaggttgagctttttaacgtatatattactcatgtagctaggctccttttattgtatgctgtatattaagtatagtataaaaaattggaggattgggaaatggaaattagaactctgcgttatttttggacaattgcagaagaaggaacggtttctaaggcagcggaagctttgcacattacccaacctactttgagtcgacaaatcaaagagttagaagaagaattgggaacggagttatttattcgagggcggcgccaggttcaactaacagaagcaggcatgtttctaaaatcccgtgcagaagaaattttagagctaacccagcaaaccagtttagaattcgaaaatcgtaaaaagcaactctttagtggacatatcaccatcggatgcattgaagccgataattctgatactttagccttaatcttagaggattttatccgagattatccgcaagttacgtttaccatttacagtgggactagtgacgacatcacagagcgtttagataagggcttagtggatgttgcagttttaattaagcccatcgccacagaaaaatatcacgaaattgtacttccccgtactgaaaaatggggattattagtgtccaaagcatcgtatattgctcagaaagataaaattgtaccgactgatttaatggggatgccgttgttagtgtcaggacgtcctgaagttcaggaattaatttcaaaatggagcaagattgactatcaacaattaaatgttgtcggtcattataatttaacctttaatgtgctcccactagtgaaacgtcaagtagctcaagcgttcattattgaaggatcaactaggaatacccatccggatggagttaaattcattccgttaaagccggaagttaatactaactgcgttttagtttggaagcgggagcgtaatctatcaccggtagtaaataaatttattaattacttctaccatgctttcaaagcatagaaatggataaaataagcattttacgaattacataaaaagtcttaacattatttttgtcgaaagatgttaaggctttttctaatcggaggtgcatagtggaaatagcttattttacccatgctgaagatggaaatactgaaattctgatgcgaaaaattgctgggcaattaaatttgccatcaaatcggattatgccaaaaaaaccatatccgataagttacgaagcattggtggaacgtgctaaagatgaacatgaacacagtattttccctgaagctagcataaaccatgaaattagtgatgatgttttaatactggggacaccaatctggtttggtgagttacccaatgtggttaaaagatttttaaaggaacagctggttgcaccacgagtaatttatcctttttgcaccagtgaaggtagtggattgggaaacagtatcaacgaattaaaagcaattttcccagacacagagattaagctagggttagcagtacagggttccaaagtaaataaggcagatcaagcagtagcaaattggttagaacagttaaatttaatttaaaaggagtagtttaattatgaaaaatgaagcagtaaaaaacggggttattttccccgctggacctaaaaatgatgcatacgcaaaatattttgtaggacaaagttacctacaggggcttgtttcagaccccaaagttaatgttggagttggaaatgttacttttgaacctggttgccgtaacaactggcatattcatcatgatggattccaaattttactagtaacgggtggagaaggctggtaccaagaagaaggacaaccagcacgccatcttacagctggtgatgttgtagtaacccatgatggtgtaaagcactggcatggcgcaactaaagatagttggtttgcacatgtagcgatcactgctggaacaccagaatggcttgaagcagttagcgatgaacaatataaggcagttgaggaaggcaaataatggcaaaaaaacagaccgcaggacgcgaacaattaggtgaatttgcaccaaaatttgcagaattgaatgacgatgtattattcggtgaattttggtcacgtgaagaccagctttcagctcgtgatcggagtatgattacatgcgcaagtctgatgtcgcaaggcttatttccccaattagaagcacacatgaagattgctaaagaaaacggcgtaactaaggatgaaatggtagaactaattacacatctttcgttttatgcaggttggcctaaggcatggtcggcgtttggattagcaaagaaaatattcgaataaaatagtaagacagctgtctcaatctgaggtaactgtctttttatttactaatggtctttgcgtaattaaaattccataaatagttaaaactacacaaccaacagttaatggtcgctccgattaaaactaaaaataagaaggtaatcatctgtataactagggtaattaataggcggttatgttgaattttattgtcaaaaagtttccataatatgtaaatattgaaggaatcactaactagtaatcccagaatgaaaagatcagcctaactagcaagcattaatttgtaatttagcccggtatgaattaagttcaacttagattacgaataacctaatgagaacatattaaaagaatcgtcagccaccatcgctaacgattctttttagtaggtaatattatttttcgaggaattcaataaataatttttgatagatttcaatgaagtctaaatacatctgtttaggtaaactttcgttaacttgatgttgggaaccatctcctggcccatatacagcaaaaggaaaatcatgcggcttatccttagctagattagaagcatcggtaatcccggggctagcagccacgacaatatcgcgtcctgcatattctttacccagtgactgaataattttaactaactggttggaaggactcgtagcaattggaaattcattcataattatgtctgtattaatttgagctccatttgcattgtaagatttaacgaatgtttcaatctgcttagccacctggttattatcgtattctggaatcgtccgaacgttaaccaaagcggtagctaaatcaggtaaggaattaatctgactaccaccattcaaaacgtcaatgttgaaacgtactggacccatttctccggatggaatcgtctcaaagtaggtgttagcttcattcaataattgcatcaatggtactagagcgttgtagcctttttcaggagtagagctatgaacggaagtacctttagaagtaaatttaatatcgaaagaacctttttgttcagaagcagtaccgtagacggtagaaggctccgcaattagcaagcccgctgcgtcttccatataataatcgcgataaaaggcggcggaaccttcttcaccaacctcttctccagcagttgctagcaaacgaattgtaccttttttgggtaagccttgttttttcaattcgatcatggcaattactaaagctgctaaaccagccttcatatctgtaattccgcgaccaaagagcttgtcatctttttcggtcatggtaaatggatcattatcccacgcggccaaatttccgggatcaacgacatccatgtgtccggaaacacctaagacaggagcgccttccccaatttcggcaactagattagcccgctgatcctcaagagggagaatttttgcctcaatgccattttcttggaataaatcctgcaaatattctgcaacttctaattcgtgatcgttaacagatttgattttaattaaatcagctaaaatttttagatatgtttgcgaatttgaaaccatagtatccattccttccttcatcctttttcaataaaatagcttacgctttttttactaaaactgccactaaaaacataagttacacatttctaaagattcagccgaaattagggtaatggtcgcaaataccttgataaaaccctatgaaagcggtatctttaaatgactaaactcgaggagatgtgtttatgtatcaagcaaataaacaacgttatgaccaaatgctttataaccgaattggaaatagtggattaaaactatccgcaattggattaggactttggaacaactttggaagtgtggatccgttagaaaaccaaaaagaaatcatccaccaagctttcgacttgggaattacgtattttgacttggctaataactatggtcccgaacccggtagtgcggaagaaaacttcggtcggattatgaagtctgacatgcacgcttatcgagacgagatgattattgctagcaaagcaggttacgtgatgtggcccggaccttatggtaactggggatcacgaaagagcattattgctagtgccgatcagagtttgaaacggacgggcttggactactttgatatcttctacagccatcgtccagatccagaaactaacattgaagaaactgctttggctttggatcaattagtgcgagcaggcaagaccttatatgtcggactctctaactacaacggtgaacaaaccgcagcaatggcagccatctttaaagaattgcatataccatttgtgattcaccaaccacgttacaatatgttcaatcgacaagcggaaaccgaccttttcccagtgctagaaaaggaacaaaaagccgctgttggtttcagttccttgtcacagggattgctaacggataagtatctcggcggaattgctgatgattcacgggccaagaaagctacaattccatttttgagcccagttcaagttaaagaaaccttagcgaccgttgaaaaattaaaccaagtcgctcaacaaagaggacaaagcttagctcaaatggcgttagcttggaatcttcgtgaaccagccttggcctgtgcccttatcggagctagccgccctcaacaagtgattgataacgtgcgggcccttgatcatcttgatttctcagatgaagagttagcccaaattgaacaaattcttggagaacaaacgtcaattgactggagcgcccgttaatccacccgtcgttcaaattctttcattcggaaactaattatggaggctgaaatgaacatcgataaaactacaatttcaaataagtttaaagaagtttttcatacagatgtggacgaagtctatttttcacccggacgcattaatttaattggggaacacaccgattacaatggaggtcatgtctttccatgcgccatcagtttagggacctacggcggatatcgacgccgaacggatggaatagtaagaatgtattctggtaattttccagaggtaggaatgttggagtttgacgtaaaccacctcgattttgacccgcaataccaatggagcaattatcttcgaggaatgatgcgcgaaattcgggatttagcccatgtggactacgatcatgggtttgaactctacctagaaggcgatttgccagatggcgctggattatcgtcatcggcttcgattgaaatgttgatgggtaccattcttagtagcgaatttaattttaaagtcgaccccgtagtcatggcgaaggcgggacaaagggtggagaacaattatattggggtaaattcaggcatcatggaccaatttgcggtcaaaatggggaaacgcaacgaagcaatcttcctagatgccaataccatggagtatgagtactcaccgctggacttaggaaagcatatcgtattaatcatgaataccaataagccgcatacgttagctaattcggagtacaatacgcgacgcgcggaatgtgaacaagctttagattgtctgaagcgaaaactcaacatcagcacactaggagacctctccaacccagcctttgatcaatacacctatctgattcgagacgaaactttaatcaaacgggctcggcatgcggtctttgaaaatcaacgtacgatggatgccaaaaaagcattagataacggcgatttgaaactatttggtcgtttaatcaatgcttctcatatctcacttcaatatgactatgaagtgagtgttccagaactagacctgttagtcagtgaagcttgggaacatgatggggtactcggcgcgcggatgattggtggcggatttggtggctgtgcgattgctttggttgaacaggatcaagtagccgatttaatcgaaaaagtgggtgctaagtaccaagctcaatttggttatgccgctgatttctacgaagccaaagtggtcgacggaccacataaaatttaagtaaaaaaccacgaaatgagaaccgcaataactcatttcgtggtttttttactttctatcatcaaactgctatgttctaactgaaatataataaaaaagacgaattacacctttttcgggatgaactacacgttttggaccaaaaactacatcttaaaaaccgtttttgacttctgtagtattaataattgaccaagggcccttggatctacaccttaggagattcaagaaatggaaaataatgaaagaacaattaagctaggattagaatatttattagaagatggccacgaaaaaatcgtgtacggcgcattaaaaaaattacacattaacactcgctcagtcgaatttgacgattttttgcaggaggctcgtttggcatacgctaaagcatacgtacgcttcccacaggacttgcaggaaaatgatcgacaattccacggctacgcctatcaggcggtttactggcgggtgctggacatcattcgttaccgacaaaaggaaaaagacgtgcaagctgtagaactggaagacgatgagaaacaagaagcccgatgggggcacaaaccatcgtgggtagaacgcataatgtctgatcaacttttccaagaggtttacaaactttgcatgccagctgaaaaacggttcttgaaagcttgttatgtggaacaactttcgggagcagaaattgcgcgtaaagaaaaagtgagtcgtcagagcatttataagtggcgaaaagcggtcggaaaaaaggccttatatgttatcggtaaaggtgaagatatggactataccaaagcactgaaaaaataggataggctggtaaaaatcacgggggtaaattttacccgtggttttttggttaggtaaaataaatgaccgataaattcctacggcaaacgcttgcaaaatattgtgaaaaataatactataataccagaagtaagaacgtgttttatagcaacactaagtacgtccggggaagcgggcttacttcgtttaggtttggttgcatataaatttaatataaacgggggaatatttttaatgggtaaggaaaatattgtgggtgatttacacgctgtaaatcagaaatctagtaatttaaaaatgttcaaggttggaaaacagtgggttttagcatcgaaagttattacgctgtttgggacagcgtgcaactccgatagcttcgaaatggatgataccgaactacaacgatcgcaaaagatagatggggtaaccagaatggcttcgtaccattattaataaaaaagcatactggctccttttttgtgggttgctcaggtaaatttctttcaaaaaaagtattgaaagtattaggcatttgtaggctagtatgataaaatatagagaacgagtgaaagcggtctcaactataaccaataaatttaaactttaaaaataaaggaacagttttaggtggaccaataacagcagttgttattgcaccgacacggtttccgaaaaatgaaaggatgattcttaaaatttaatattacaagtctctcatggaggtagggccaagatgtcgtgaggcattaagcaccgccactgatctgagcttcttgggaaaatctccttgaagtggtggtggataaacgttctttgagaacaaggggaggggcttgtaagactaaataaccactagtgtaaggctactgtacgattattgtaggaattaatcggttaatgacggaattgtgcgcaaaaaacgattttcgcaatgtgcaattaggggatgtaattgagttgtgaaatgacgcattttatgggtgagcagtaacaggggaagtccgacttcgatgaaggcggcacgcaatatcgcaacaaagggttttgaatcaagctccgtaaaaagtggtaagaaaaaaatacttgagcaagtacatctgtcggggaagcgacagatctgggatgataatgattcacttgggaagaagtgaagaatggtaagaattaaggctactgggggcagtagttatgggtcggaatctaatggatgattttcatagattttaggtaggctaacaattccaaaattaaagcgcagtttaagttaaacactagtaaataagaatcttccttacaagtaaagtaatagtctagaaattttgataataaaatttctgggctattttcttttgtatcgaatgaacatactaattatcgaaaatgaaaaatctccactgttagataaaaatctgacggtggagattttttggataataaggaagtaattaggaagggagaagatgaacgctataccaaacgatttagttgacgatatttacggggtgataccgcatattctttaaaaaattctcttgaaaaatttgcggtgttgtaaaatttaagaatctgagctattctaccaatcgacattgaggtgtttaataacagattctttgcttcggtcattttaacgtgacggatatactgggtcacggaaaagcctaactctgcgcgaaatcgagtcagagtgtattttttgtccaggtttaaggttgcgaaaatctgatcgattcgtaagcgttcataacgatgcatattgatatagtaagcggtcagggcgacctgtttagacactttagaaaaatcgacgttgcgggtgggttcgtcgttatatgaaaaaaatgtctgaacaatatcaaacaaaatatcgcgaaaatcttcaatttttaggttttgggagcttaaaaatttgatgaaggcgagccggagttctaagaaatgtgcgatattgaggtgggtaaaaaaactgatattggtcaggccgcctaccaaaccaattagagactgtagcaccacctcggaagataaatcttgaagtgcgcagtctctaaaaaaatgatcgatatgttcgtgggcatgttcataatctttattttcaaagaagtggagaagatcatgttcaagcaatgaaaattttaaaataaatgatcgatcttgagatgttaataaagaaggatccaatttaacaattctcataattcctccttcctaaagataatttcttccttacaaaaatgcattttgtcgaattttcaaacttaattcaagcaatatgtttgcaaagtttaagattgtctataaaaagtacaaaaacacccagaatactacaaataagggtttttaaggaggcgtattgtttgccaagacatcaggataaccaatataatacacttattaaaagaaagtaaccccttcaagattattgaaaataatcttgaagttccaatgttagatttttctaattttatggctgtttttctaatctcaggatatcaaaattgtccaaactggccaaactgattaagcgagaaagatctaatgtagataattgaatggtcgattagctattacgattaagggactagcaaagtggctaagcaagttctttaaactataacatttaatcgaatgaaaattgtcaaaagatcgtcggtggaattctcggctacgattttaatctggggggtcaagtggacaaaacaaacgcggatgctttaagtagcaatccgcggagtaaatgaattaagacgatttcaccgaagggtagcaaggttgacgatggcaactccactcttttttacggtcgcaggaagaccgtctctcccagagctggagtagctggtagtgaactttgctatagaagatattggcgatgaagcccgtgacatcgacgatatctaatcatctgaatcacaaccaacaggggatggttcaaacattatacgacaactcccaaaaccgtaaaaaaaactttaccctgagtggcgagaagcaagatgattctcaatggcggcgaaccattggcaggaccatatcacaggcacatcctagggacctaatgtacttaaccttatattatttcccctttggaagtctccagtgttaggtgaaaatctagcactggggatttttgatggattaactaatctgaaggtaaataaaaaagccatcctgctgaagggatggcgtttttatgatagctatttatactaagacatgcgaatcaaagacgttaaaacgtcggatgacgtattgattgcgattatttttgaccgcccatacttcaatagctgatcccatcttggcttgttgaaaaaagtttagagcatgggtatgaatcagcatgttgtagtgctgatcttgcatattcgtcagggtaaaccgaaataaaatgggagagtaactgatacttttaatttcactagtaataattccgcttaatttttccatataatcgacctctttttgataagtaaattatacgaacaaacgttcgttttgtcaattagcaagcggactattttggaatcaaagtgggcgttaatttaaattagacgtagtgcaaagtaacaccactcaagtaaagtttgcctttaatataaagggttggacctgtaccagaattgcgaattccccgttcatcaatgccggacattacagagttaatatcagtcacgatattccaatcgtgggggagatatagtgtgatgtttcccagttggcaattgatgttggcagtggcagaatcctcaagatgggcttgatcaaaatacaccttagtagttcccatgtagttatttatattgatgcttttcaaatcttgagattgaatataatgaataccactgctcatgctagtttcaatattgattacgtcatcatcagcggactgcgtactttcagtataatcgtagtctgagtgatgattaaaaccatgctgaaattttttccatggtgcatgcttttgccaatttcggcggtaaggatgaaaaattagtgatagaccaattgttagaagaacggccgctaacagaatggtccatggcacgagactactgataccaaggggtttaccatatagcattaataaaaatgcaattgaaaagatggttccagcgatggacaagtggacgaggttgacgaccagtgcagcaattaaaaatacagaagcgacgacggagaacggatttaaggtgaacgccgtccaccccatctgcgttgctactaaaacagccgcagctaaaacgaataatgtgccccaaaaccattgtgattttttcataattaattacctcaacttttttaaatgttcttgtaatgatttatagtaccgacgagatgcataaacttgtttatgcgagttttgaaattggactaagcagttcgacaatgatttagttaacgctaagattttattaacattgacaatacaagatttagagatacgaatgaactcaataggaaggttttcctctagctcgtatagtcgctgatgcgttgtataaagctgattttcagtgtgggcacggacttgtcgatcctcggtctcaaagaataaaatatcgccaacttctaggtaaaattcagtggaaccggaataaaaggtcataactttttgcgtagcattttgtctttttattaattcctgaatttctgtaatgtttttagtaaactcgggcgctcgaataatgacttcgccctctttaatatttggatcaatttcaactcgcattttcaatgtcgatcatcctttcctactaagtacatcataaaaaagagagcgggtaaatgggtaagggttaagtggttggattgagcgactaggcggtcaaaaaaactgtaagaaaatgattgcagcagaatctagctgaattggttttcttacagtttttaagtgcttatttagaatatttttgaccgagcagcatgcgacccgacatggttcttaaaattaaacctagatgggtatgatgaaggtcatcgccagttttacgatatagcggttgaagttctgaattccaaagggcaaaagttgtcgtaaatgttggaaatttccaatagcggtgccggtaacttggaatcttaatccagcgcttttgcgcaacacgaggttgatcgacgtattcaagatcgatgtgagcctgagactttgctgcaggtttcacgtttttttgagggcgtgcggccggaaccgcagttggcaagcggtgctgctggagccttttttgaattacgacccgtttttcttccatggtcagcggcgctgccgtgggcgtggcgctcggtaacttggttactgttactgggtgcgattgaaccggcttaaccacaggtgctggttgaggaatcggatcggcttttttaggtgtcttgggcgaactactaggtttttggggtgcaagaggttgcacgacatccgacttaggttgagctggttttttagatcgcagatgaacatagtaggtcaccgaatcaccattgatctgatcaaaatcgaggcatttttagggaaatcattagtagttaacgtatatccttgactttcatattccttgatcttacgggttggatcatacgtattggcctgattatagtagaccgaaacttcttttgaaagcagctcttgatgagtgcgatcatcaatgaattttaccgtagcttttttatgagcccgttcgtatctaactgtatagtgcaaatcggaactattagcatcgatcgtttgttgatcaacctgttgatggctagaacggggcgcattattaaaagctacgtgataacccttgatggttggattagggatggcagctaaagtagcttgattgcccctagtccaattctgctggtccacgggtcggccttgttgatcgagcgttaaagttgttttagttcttgaaaaataagtaacagttgtgtgatgaagcgcatctgctaccgtcgcaaaggtaacgggctgagcgcgatatggattagcaagagccttaccattttcatccacatactcaacgtattcgttgatagttttggtggtcaagtggtatgctggagcgtatacataagtaactataccattgtctccatgatggcttaaaataccagtggcgggaaggctaccagctcccatgcgaacaaagtgataattattaatactttggggatgggtagtgtagggccggcctacaaaagggccgaatggataatcggcagtcccggtagttaagagtttccccgtctgatccacataccgtacggtaaccgtagcgtgatggtggtgatgatgatggtgatatggtgctgtagatggcggattagtagccgtcgcactggaactttgagtagcggatgaagacgccgtggttgtactgctagaactcgtagccacggtcgttgaattagcgtccgcctgataggattcagcattagatggggaggttggttttggagtaggtgttttagccgcccaagcggtggtcgaaactaaaaatgtattggtaacgataacgatacttaacacaacggtaattagccattttctactcttgttgtataatttggtgtagtgctttgttcccaagatgatttacccccagacatatttttagagtctatattttgatgcctttaaaaatattgttaacaaatcaccttaaggagttaataatatgatcgagaagtttaaccgattattggacgatgagcagcagttggtcctccaactagccgaactgtatatccatgattctgagaagaggctttcgataggctatgttcaagatgagctgggagttagtagacatcaggtgctgggcgcgtttgatttactaaaatcaacgattactgcacttcgtattgaaaacattgatttggaatacgatggcaagggagtcctgtcaatctatggtctaacaacaacttcaatgaaaaccattctggaaaacatggcgaccaggtcaattcgtttgaatatttttataaattctcaactgggaatttacggcacccaagctcaattcctaaagcaattcggaatcagtcgagcaacctattatcgcaatattatttatattaggcaaattctgtcggaagaactcttcaacaagacccatcgcaatgaagaaagtgtgcgacagactatttttagcgtgattcatcattttttcaatggaattgatgcgatgccgattgagctgggagagccggtggacactttaatcaccgagttgagtgagctaaaatccatgcatttaagctacacagaacggcaacgcttgacgaattttttgtttgtccaaactaagcgtattcgtcagggaaatgtggttaaaaagattgtcgataaggattgcgctaaggaaaagttggattttctagagccactgagagatttatgggggttagaagagcctgatttaatccaagaagcttggtatctgaacatttattttatggtcaacgaactagcaccatttgaaattgaaaagtgtgggaatcagccgccgttaaaagtaattcaaactttggtggaaaaacagctcgattttttgcaccaaatttttgaagggttagaagtagacggccaactagcagagattcgacaggaactactggaaaccaatctcaaagtattttcgccattttatttcagtgagacgtttgtagatccaactaaggtgccctttttcagtgaaacttatcctgaaattgacgagatggtgaaacaaattttggcgtatgtaggcgagcaacgtaaattaaggcttgataaagatacgttaacccagctatattatacttacatgttaattttgctggaacatctaccgattcagttggtaagtagtgtcgtgaagattacggtcgatttttctaatggaaaagtttttaccaagtacatcacgtctcagctacaacaatttgcgcccccttaatatcgaaatttctaaacgtctggaagatgatacggatatatttctatcggatcaacgtttttatgatgtcgattgtgagcaaatgatctgggagtcaccacctttagctgaggattgggaacaactaggtgatttaatcgtaaaaattaaacaaaatgataaaaaaataattaatagctaaccaaagactttttaacggcgtccgctcgggacttactgttaaaaagtctttttgaattttaaggtgcattctcacgattttaaaattagatgaaaaacgcgaaacatagaacccctttacgataagagacacggattatattataaaaacgtgctagtccttgattagcacacggggggatcattctaatatcctttttgtaggataaggaacgacgggaagctgtgaagaaaggtcaaacgtacgatttttgaggaatgttcgtgcgcagcccgatgaatcacagcttctttttatcacgatggtagatgaatgagttattggtggaaggcagaaatgggcgcaaagaaaaagatttggttttgggtgatagtaaccttgcaggtaatatttgttttaaaaatggtacatgatacatacttcaatgatcgttgggcaacgaggtacaatgtccgttccagagagacggtagttaaaaatatcaattacgccttagaaagcaatgattttagtggcaccgccttggtgattcggaatcataaagttttgttgcataaaggctatgggcaacaaaatgcttcacgaaaaaatggtgtggatactttgtataacatcgcctcgattgaaaaaagtatgacttccgtgatggtagcgaagttaattcaagaggggaaattggattatgctacaaaactggctgaattttatccgtccattcctaacgctaaaaatatcacgattcgtaatatgttgaccatgacctcggggttagaagcagcgagtgatccagaaaaaacactgagtgaaaaagcattggccaactattacgctaagcatgtggtggtcgatccgcgtaagggatgggattatgatgcgattaattttcatctgttggcgggaattattacgcaactaacgcatcaaagttacagtgctagttttaatacgttagtcaatctaaaaaatcaggtaaatgtgatggtgatgccggatttttcgaatccccaagtggccgtaagctaccacaaaaatgggcaaccgttcgccaatcctcgctacgtctatcgtaatgagattggtaccgggagtttttttatgaccgccggcgacctttaccgttacttttcggccttggtcaatggcgaaattttaccaatgaagaccatcaaggagttgtttaaaactgtcccacatagtgtttatgccggtggagtctatcacaataagctttactaccgcgggcacggcatcttgcagggatatgaaccttcaatcattttcaacaaaaaggccggcaatgccgtcgttttgttgggaaatcgcagaggtaaaacaacgacgatgaagcgaccaatagtatttattcattggtcaatcaaactccatatttaggtggaaacacgtattaattaaggagaaggtaagttaaacatggatgtcacggcaatcgtacctgcccataacgaaggtgcaaatattgaagcaacgattaaagcgttaaagcaacaagttcgaaaagtgattgtggcgtgtgatcactgtacagatgatacttatcaaaaatcaatccaggcaggagcggtggcttttgaaacggttgataatcaacatcgtaaagcaggggcattaaatcaagccttagaaaattacgttgattggcaattacccgaccaatatattttcatttgtgatgctgacacggtgattgcggatgattggattgaacgggcccagatagcgattgatgctggtggttatgatgcggtcggttcagtgtttttcggggatgcggatcgaagttcgatgatcgaattttgtcagcaattggagtggtaccgctacaccaatcagattaagcggagcaaaaaagtttttgttttaaccgggaccgcttcgatggtaagtgccgagatgtttcagaaagttaaagctcgcaaaggtagtttttacgacgaagactcgattaccgaggactttgcgttgacgattgatttaaaagaggcgggggccagaatcatttccccaatctcttgttactgcacgacggaaattatgcccaactggcgactactatttttacaacggcgacgctggtatttaggagcgttgcagcaaatggttcgccgaaaatgggatcgcgttttatttccatacgtttttcaacaattaatgttacttatttcagtcctagcatttatgggactgattgttttcaccggttacttaatggtgcaagacttgattatttttagtttcttttggtttttaattggagtgatttttgcagtcgagcgggtgattacgatttggaaccaagatcggcaggcaaagatatttgcattaatgatttttccagaattaatttatagtttatttttacaaattgcgtaccttggggcgctggttcagctgttaagcgggtcagcgggtacgtggaatcatctagattaatgatttaattcaatagggggacgaaaaagttatgtattcaaatattcaaagaagtggtgtagcttttgtaagcttaagttgggggttcatgtatcaccttattagcaacgctctcgatttttttcgcaattcttgctgtgggggacgattattagatgcatttggtctgaaaaacaccaagatccaaattggcaataaatgattccttttaatatttataaatcataaatagaatggaagcgagattgggagaggttttcatgaataaaaaagggtttctgatattggtgatggctgtgctatggttttggggcatcaatcgtaaaccactcagtgttcgagcagcaaccgattggggcgaacagtttattactaatgttgagttgagaaatagcaaagataaagcgcaaactacttttggactttacgataatatgaagattcattggaattttaatattccagtttctaaaagagtcacagctggagatacgatgactctcaaagtgccagatagtttgaagttagttagtaatgttaaatttgatgtgactgatgggcgaggtaacattattggtaaagtgcaagtcttgaaaccaactaataaagttaaaatcaaattgacagaatatgtggagcattatgtaggtggagtgaaaggtgctcttagtgtccgaacgcaatggaattattctaaggtcgatcaaaaccaagtgcaacttttaaattggggagctgggcgggcggctcaaattaagataaaacccaatggtggtccgaatccgaatgagactttatatcagtggtcttggtacgatgtgaaggaccccacgttgatacattggcgagtgcgcgtgaattatgctaagcaaaatctcaatcaggtcgattgtaccgaactaattggagatcatcaaaagcttttaacaagttccatcgaagtcatgggagtggcttttgatgaccaaggtaaggattttgaggtaacggcaacctgtcctaaagtgaaaatcatgacgaatgggacgaagggttttacggttggattaggaaagattaagcagacctacgtaatcgactaccaaacgcggatttcctccgtagatcaacatcgccattatcacagtcaaggagatttaacggcggccaacctgacctcccaaaggattaatacatatgttccagaaagtaagggcgttggaacgggacaggggtggcaaaacagcacggagaagttaagtaacacgcagtcaattaaaacgggatatatccaaaaggatcgcccagttttcttagccgaagaaaaacagactatcattaaaaacttttcaatggtcggagcgagcctattggccctgattgggtggttcatttatcgtcgccggaaatgatgtcagaaagaacttcggaaaagagtaacatctaatacaaaaaaagacgtccactgtgagatgtcttttttgatatagcatataaaatattttacatagagtaattaatttttatgtttctttttggaaacgaaccagcgttgaatcacaatcaaatcggcaatgacaagtaaagctgcggaaatcatgaaagcaacatgcattccgaagataaacagttgatcgttgccggttggataagtagtaatgctacgaccgagtttggcgcccattactaagaaaagcgatgatgtagagatactaacgcctaaaatcatacctaggtttcgagctaacgcattaacactgccagcgatccctagtcgattacttggaacggcggacattacagatgcgttattcggcgattgaaacataccaatcccaattccggtaacaattgaagtaaaaataaagtaccagaacggagtgtccaactgaaagcccataatcaaaaattgggctaacaataccagcgtaacaccgataatggtaattttagttgaattaaatttctcagctaagacgccaccaatcggtccaaaaattaccatagtaagtggaatgattgaaagtaggactcctgaaagtccagaggataaaccacgagcattaactagatagtaaggcatcaaaacgtcatcaaatttaatttcaccatgagtaggttcatagaaacgttctaacaaactaaatatcgttgatttaccaccgcccgaaggtccggcaaaggcaattacttgattaggtttagctttaaacgaaatatcttttaacaccgtttcttctggcgtatcagcgtacgcaaaatcgacatgttcaacttttaaattcttatcagctaaatccaaagtttctccacggttaaaatcttctggttcttcttcaagcaactcttcaactcgtctagtagaaccggaagccttcgccatttctgaaaataacgtcgcaatgatgggcatcgcaccaatcaaattaaataggtacatcagaaaactcatcaaagtaccgatttccattgccccaatcgcaattcgatgaatcccgtatgctaacaggccaaaaatcatactcatgaaaaccatcatcataattggttgcattgctgcatcaaaaatagcttctttccaattttaaataaacgatttatttcattatcagcatgttcttgagcttgattttcggcattcgaagtctttactaatctaatttcacttagtgtttcactaacaattccattaaataatgctagagcatcttgtcgaatatgaccaactttagtaccgaaagccataactggaaccattaaaattactactacagggacggcaattaccatggctaaagtcatgtgccaatccatccgaatcatcatataaatggtcccaactacggtaataatgctggcaagagtttgaggaaaagttacggctagcagttgcttaacttgattagtatcgttgacgagccgacttgaaatttccccggccttgacggtatcaaaataactaacttttaaaagagtcaatcttttccacaacgttttacggagattttggataacattctccccaaaaattcccaacacagtgccgccaatcgctgaaaaaatagccgatgcaacaaaaagtaaaactacttttcctagcaatgcataatctacacccttggaaaaattattaactaaggttgaagctaattttggaacgtatacttggactcccgagctaatagctaagaggaatactcctaaaaataaaaggacgtacttaggactggttcgcttaattaatccaaaaaattgtttaaaattaaatttagtatgatccttgcgaatcgtatcattgaagcgtgcattagttgccaattttaacgccgtcctttcttccaaccctcaaaaccaccgaaaccgttaaaatcacctggttgcattctaccaaagtgattgtggcgcaacatttgttctcgagctctttcaaaatggggactcatcttgccaaattgtgcccagcgttgatcattatcaaatacttcattaagcttttcactaaattcatcgctaccgatgttattaaccatccgttctaggtattggtctaaatattctagttcactatcagagaaatctttgaataaaacgtcttttaaagtattcccaatcgaaccatgcgttttcaagctttctcgacctttatcggtaattttcacaactgtcacccgtgaatctttaggtgatttttctcgtagaactgtccccgctttttcaagttttttaataatttgagtaacactagaaggcttgatatctaaatattcagaaatgcgtccaggagttacatttgtttctttagccaaaagttttaaggtttccaaagcattatccgttttttcttctacgcggttagcaaaaactaaaaaaggttcgtgactaactttcattaagttatctaaaatttcatctttattcataataatggttcctccattttattaattgatttatttagtttcagttaaatttaacaaactaaatactattatcatttagtttgtttgtaaacaataaaactaaatatttttaatgcacaaaaaactctcaattctattcggttacaccccgtaaaattgagagctttaattttaaaactatttcatccgaaaaaggcctagttccggattcatttccagttacttaacttttaaatcttttaattgcgcttcgacatcttcaattttagtctcaacttgtaacaatgccgctgccgtataggcactttcaaccagggcggtgtcatacaacttaacttctttatccgtcatttctatcgccatttctaaattcattttggcgcttcctaagtcataaaaggctaatagcttagtcgcagaattatcctcaaatgcttgtataattcgttgcatatcggttcccacatcaccattttctagcccaccagcaatcgtaactggaacatctttagcgacttgttcgattaaacgtttaacgccttgagcaatttcactaacatgcgaaacaattaccacaccgtattccataactattcctccacttctagtaaggccttcaagaggtaacctgaagacatggcacctggatcaatatgccctactgaacgttcccctacataagaagcgcgccctttggtagcaatcatatctttagtagcttcgacggccttatcgacatcatcagcagtaaaatcagttttttcagcaataggagcccatacatccaccattgttttttctccggtttctgctttcccccgtttcttaattccagctaatgctgctggtaataacgcactaacttcaccgtctccaactttggccatttccataaaagcagtcccaaacaaaggaccagaagctccaccaactttactaattaagctcattgcgattgttttaaaaatagctggaacgtccgtaaaatccttatcggcgatagcttccatgactgcattcatcccacgcgccatattgtttccatgatctccgtccccaatgggtgtatccaattcacttagataatcgtggtgagcttgaatttgttcgttaaatttggtcatccatttttttacattttcaacgtctaacatactatttctctccatcctaattaaaattaccaagcaatggtatctgtggcgtaatttaggttttcaacaatttcgtcggataccttaaacaaggttagtgaaattccggccatttcaagcgaagtcattaaactacctaccttggtgaatttaacttccagacctaaatcagctaatttatttaaaacatcgttcataaagatgtactgctccataagtggggtagcccccattccattaactaagacagctacttgatcgcccttttcgaatttgaactcttgattcaattttccaaccaattcttctactaaggccttggaaggttgtaacttttcccgccgatagcctggctcaccatgaatacctacaccgtattcaatttcatcttcacccagtgtaaatccaggtttacctacttctggaacagttgcaccacttaaagcgactgcaatcgtcttgatattaggcaaaactttttgggctaattgttctagttcgtctaaattggctcctttagccgcggccgcacccaaaactttatgcatgaagatagtccctgcgacgccacggcgtccttgggtataagtactgttttctaccgcaatatcatcatcaacaactatcgatttaactttaatatcttccatttcagccatgtcttgagccatttcaaaattcatgacatctccagaataatttttaattactaagaatacaccggctcccgaatcaactttcttgattgcttcaaagatttgatccggagttggtgacgtaaacacttccccacaaaccgccgcactcaacattccatcgcctacaaatccagcatgagtgggttcgtgaccacttccaccgccactcacaattccaacttgaccttggatattttttaagtcatgacgataaactacacctgtttctggaattctttctaaatattcggggtaacttcttaccaatccttgaaccatttcatcgacaacattctttggatcattaatgatttttttcatgaaaacattccctcctcggtaacttttttcgtacaattaaagcatagtagaaagcgattacaatcacaagaataaagcctaaaaagtttaataaaaataaaattctcgtataatgaattatatgtacaaaccaaggagaacgatcaaatgattttagaacgcagcaatatgtttaataacgaaggtatcaataaagaactcacgcgtgtaattggatctgaacacgttcaagaatttagcaacttagtacgttactatcgactttgtcagtccgccgtaaatgaaattggaaccaagcttgaaaacttggatggtgaatatcgaggagaatatgaccataatcccattcatcatatggaacaaagaatgaaaactataacctctctttttaataaggcagagaaaaaacatttagaccgtgatatcgagtctattaaacaaaacatctttgatattggcggaattcgcgttgttactaactatattagcgatgtttacactatccaaaaaaatctgctttctcaaagcgatattacactcattaaaactaaagattacatcaaaaatcctaaacctagtggttatcgcagtgttcatctagtagttagtgtgcccgtatttttgtctactggtccggtaaacactcctgttgaaatacagattcggaccgttggtatggatatgtgggccagtttagagcataagcttcgctataagaccaacgttgctgacgaaaaagtagaacattttgaaaatcagttagtcgaagatgctaatgaaatttttaagattgaatcaaacatgcaaaatatttatcgtgaattatctgacccacgggtgtttaaagatgaaggataaacatcccgtcacgtgtttttatggagtcccaatcaagcttgataattccggtcattacatatttaatactgaaattaaaatccatgcctggcggaatggcaaacacactaaaggaaagtttctgaaactcggtcaattatttttaaccgagaacaatttactagtggcaatcgtgggtgcaactaaattaagctttaaaaatcgccataattttgttcctttagaacgctttactaaggaatttatttcagatgaaatgctggaaatagctatcaaaaaatttaaagaggaggcagtttagtgcatgcaaactttgattatcgtcgcacatccagaacttgcaaggtctaatactcagcccttttttaaagcggctatcgagaatttttcaaatgtaacttggcatcccttagctgcagattttaacgtcgaacaagaacaatctctattacttcaaaatgatcgcattattctagaatttccgttgtactggtatagcgctcccgcattactgaagcaatggatggacaccgttatgaccactaaatttgccgctggtcatcaatatgctttggaaggtaaagaactaggaattgtggtttcgactggagacaatgggaatgctttccaagctggggcagccgaaaaattcaccatatcagaattaatgcgtccttttgaagcatttgccaacaaaactaagatgatgtatctcccaatattggccgtccaccagtttttatacctagaacctgatgcccaacaacgcttgttggttgcttaccagcaatacactacgaacgttggtggaggtcactttaaagaccaggccgcttggtttgaggcagaactacaaaaacggattgatcaacatccatcacattctgagcaacttcaacagattttattcactattaaagagcgtcaggatgaactcgacgatttacaatggaatttgattgaaatgaaaaaagaggaggatgtgtgatggatgatcaaaaatggttaattgaacaaattgaacagctccgtcaatccgcttcagactatcgagaacagtccttttatctaggattaaaagactttgttcgggaacaatcgaaaagaatcgaccaaactcaaagagaattagacggaagaatgtgggaataatttcactaagacaaatatattccagcaattcttaataagtaggcatcaaaaaagaccatgacattgttaattgtcatggtcttttaaggtttagtgttttttatcctcatgtttcttgtcgtcctttgtgcgatctgaccactcttcgcgagttaacacatctttgacgttgagtttaatctcagcgacttccatgttggtcatctcgttcactgccgcagtgatttttgttaccattttatcaaaaatagattgtgcattcttaccatattctagtaaagcatccatcttcaatgaaactttttgattttcgtcgtcgatatctacattaacacccgttgtaggatcatcgcctttagaaattcgatcagtcactttttcaaaaatattaccttctaatgaaagtaccccatcaacgttgcttgctgtttttccagcaattttagctaatacttcatcatcaaatgttagttttgtttctggttgtgctactttatccatagttatagatctcccttcaaaattttcgaagcttatttagcttctggcttaggttctaaatcagaatttggtttgcggttattttgttctttccactgttttttacttaaaacattgtttacgtgaaaatcgagctccacaaccttcaaaccagttagacgttccacttcttcgctaactacatcacaaactcgagtaaaaatttcacgaatatcatagccatactcgacagttgcattcatctcaagcgccacctgcttttccccaacttcagcagtgattccttgagttggatctactttacttcttaacttatctgtcaaactatcaaatagtccgccgtcaaaggaaagaattccgtcaacttttctcgaagctagacccgcaattttttcgataaccccttcatcaaaggttaagcttgcttttgcaattctaggattgtccatgatttagcacctcctgaatcttacgacgatttttccatgcaaaccataaacttgaaacaaccatcattccaagtaatgatttcaaaggtttattacgatccactttctttgccattaaacgtcccccctagttcttcttacgatcaatgttcaaagctgccattagttctgaaattgcctgtgataaaactgacttaccatatctggcacctaggtatccaaggattccaagcactccgaccaacactgcgctgccaaatccgatcgagacccagacaattccgagaatcatcgcaactaaagctcctaacaattcgctactcatctaaaatcccgccttcctatatgactttcagtgacttactggactgcttacgcggaatgatttgaaccttaacatggctcttcattcctaaatgtctttgaatactatcttgaacagtttcttgaatctctttggcattcacatcatagttcccatccgatatatcttccacgcttacttgagcttggatccgatcatttccacggacacgtactttggtttgaatattacccacttgatgattctcagcaattgacttatcaacaatttgttccatcgacttcttaggaatggtcaatttgcctcttccgccttgcaatttcaaatctttctcgctagttcgactagatagtgcaataattaacatgactagtgcaaacagagcgacaataaccccgaatacaattgcaacaacttctgtaaggcggctatttgtggttctcatcgattcaaaaaagtcggtaagataaggaatgaacatttcacttgaaacgaaccaaaccgtttgaatcagggtaattactgccatcaaactcaataaaatcttactggttcgactcatgtaatcacctctatcccttcttacgcattccgaagataacagatacaattacaactaagataactgctccgataattgacggaacgagcgccatacctgctaaggaaggtccccatgttcccaataggctttgtcctaaccaagcaccgacaagtccagcaacgatattgccaatccagccagccggtaaatcacgactagttagtgctcctgcgatggcaccgataataccacctataattaatgaccataaccatccaaacatataaaacaactcctttcagtttatgctgataaccaataaacgctattgcttgctggttcaccattaggatatcatgttgtcagattgcatatcaaagaatatgcctatcattttcataaaatatacgatttgaggtagcactttcttttttcaaaatagcaaaaaaagcccacgctatgctgagcttttcggttagaactagatttaattcactaaaataaattttttcttgaaaaataagctgtttttatttaccaaacgatattttacttggttttactagctaatttaacaattccggcagccataattagagctccgcctgccaaattaagtacgccaccgacaatttctaaaactccactacctttttcgttcttacgcattatctttcctccaattattaaaaaagtgctcgaaatattgtaagcacttactattttaactattttgttttaaacttattatataacttttagaaattaggtgactatagtgataaaaatgattgctacggatatggatcaaaccttccttgacaaccaaaatcaatacaataaacaacgttttagtgaaatttttcaggaaatgcaacgccaaaatattcacttcgttgccgctagtggttctcaacatgagcgccttcaagcgctgtttgaacctcaagctaaacagatggacttcatctcccaaaatggctccatcatctattccggcaacgaattaatcgatgtgcaacaaatctctccaaaacttcttcaagacacactagattcgattaaccaggcttttggtccagatgaagttttaattaatatttgcggcttaaatagttcatatgtagatacaaatactaccccggatgttatgaacttcatcaaaaatttttacaaagaaattcaaactgtcgatgatattaatcattttactaagagtgggattgaagatccgattgtcaaaattgctcttagctttgaagatagtcctaatatcaatcaaaaaattgagcgtttacgaagtcttctagatcctacgttggggagtttaagctcggggttcaatactgaactaatcggtttcagtcacgtagataaatcaactgcacttcagcatttaatgcaaagatataacgtaaacgcagatgaattggtgacttttggtgacaacgaaaatgacttacgaatgttacaaatgactcctaatggatatgctattcaaaatgccttttctaaggttaaagcagtagctaaccatttaactcgatatgataatgaacatgatggtgtattagacaccctagaaaaactattataaaaaatcggcggtcaattaacttttgagcttaatttcaaaagttttgacaacgccgatttttttagttaaattcacttaaaattgcttggtacgccacaaccgggtcctcggattgagtaattggtctacctaccacaatagctgagcttcctgctttggcagcttccgcaggagtcatcgtccgtttttgatcaccctttgctgctccggcaggtcgaattccaggtgtcacaaacagaaaatcttctggaagttggggttttaaataactaacttcgtttggagaacaaattacaccatctccgccagccgtactagtcaattttgctaggctaagtacttgatctgccattggtaaactaacattctgttcttcacttagttgcttttctgaaatagaagttaattccgttactgctaatagtttaggcgttggtaagtctacttctctagctccagcaaccaatcctcgtttagccgctcgaatcatatcagaaccacccatcgcgtggattgttgtgtattgaacccccattcgacctaattgcatcattgctttttctaccgtattaggaatatcgttcaattttaaatcaagaaagatgtcatgccctttttgacgcatatctctaacgatttcgggacccattccgtagaagagttccattcccaatttaatgattaatttcaaatgttccggaaattgctccaagaattggttaagttctccccgatctttaaaatctagcgcaatcataactggtttttccataaaaactccattctgaaccgctcttaacatcaaaaaacaccgcaaggtctaggtatgctaaccagcacctagtttgcggtgtattcgttagcttatcaatctctctggatcgatttaaaacgactcgatttatttacatttatgctacttgcctagcctttgaatgtcaagatgctaaaaatggtaaaatggtattataaattaattaaggagctcaacatgattaagagtgtagttcatgatcaacaaattttatctcaaacgtcaattcccgctaccaaacaagatttatccgtagtaatggatttgatggatactttaaaagccaatagcgaacgttgcgtgggaatggccgctaacatgattggtgttcataaaagaatcatcgttgtcactatgggaatgatgaacgtccccatgatcaatcctgtcattctcaaaaagggtaatccatataccactgaagaaggctgcctgtcattaaccggtgaacattccaccactcgttacgacgaaatcgaagttcagtatcttgatttagaatttaaaaaacatacccaaaaatttaaagaattcatcgcccaaattattcaacatgaagttgatcattgtgatgggattattatttagttttggagaactagcattaatttgctagtttttttaatttatcaccagtttattccaaacaaaaaagcccatccattttagggggcttctccattaaatatcttttagcataattaaatcacgttgcaaatcgttacctaattgaaaaacatgttctccaacttggttaaatccttgagtttggtaaaatttcttagcagcttcgttatgctcccagactcctaaccagattttacgtttgtggttttcttgtgcaacctcaagtgcctgttgcattaatctagagccaattcccagacgtttaaattgctgacgcacgtaaatccgctcaacttccaaagtgtcgggctccattttttctgactgagcttcatctatgttgacttttaaataccctacaagctgatcagcttgcttagcaaaaaagaagtaggatgcatcattagtaatttctgaagttaactgtttgaaattgtatgctttttgatagtattggtctagatcttcagaactgttatctgcgccaaaagtatctccaaaagtctcaatacttatcttttgtaacgcttctacttcttcaactcgtactttttgaatatcaattgtcattcaattcacctcaatattttctatgatgaccactttttacatagttccagtcgatactaacatttcgttcaactttctccagcattgctttcaatgctgtagcttccgcatccgtaaatcctgctagcgccattctactcgaatagctattttcgcgtttaatcgttggatatactgccttaccttgttcagtgggatatagacgtttaatcttatgattgtcccgatcagctccacgtgtaataaatccatccttttccaacttcattacggctcgagctgcggttgtccgatcaactcgaattttttcagctaattcaccctggataattcctggattttcacatattcgaaccaaatataaatacttgcctttggttaaatttaattctttaaattcaatattagcaatcgaatccaattctcttgaaattgatccaattgatcgtaaaatatcttccataattacttccctctgagagtattttactttaatttagttgcaaatacaacaaaattattttttgattgcccgtatgatttgttcgacaattaaatttaaatcttttgtttcgtttgaattaccgatgaatcgatgctgaataaaataaataaaaatctgtccaatcatgattctcattacggctggaaaatccaattcagatcgtaattgtcctgttttatttaagttctctcttacattttcaatgactgattttcctggttcatttatcactccaaaaaataaatctcgaatatcacgattagttagcaactctgtaattaaaattagaattgcgtcttcattgtctcgtacaaattgataacggttataaacaaagaaacgtaccatatcttccaagtcagtgaactgcctcaattcatcaataaaactatcccgaaaaactggaaataaatttataaaaactggtttaagaattcccatcagtaaatcttgcttagttttaaagtatttaaatatagttgcctgactaatttcagctttttcagcaatttgagccgtcgaagttccattaaatccctgtttagcaaataaatctaaccctgctaaaagagcttttttctggcccttaggaagcttttgctcatcaagccacgttttataattatcaaatatgattgcactactcattatttacaccttccgatatcgtttcaatccaacgatatttaaaatagttaagataactagaaaaattaataacactccaatatctccccccaaagctgaaagtcgggctcctcgcataataatattactaaccgcatcgccggcatacttaagtggaataatataagatattttttgaacccaagcggccatcgtatctaacggaataattccagcgaagaaaacttgaggtactatcacaattggaataaattgcaccatttggaattcagaatgagcaaaagtagaaagcagaattccaaatgctagagctactaaagctaatagcaagttgataacaataatgctcccaatattgccaaccacttccactcctaataatccaatagttaccaatacgatcactatggtttgtaatatagcaattatcccataacttagcatatagccaaatacaatttcagaacgtttaactggagtcgctaaaagtcgatctaaagttccacttgttctctctttcaaaagcgccatcccagaaactaggaagacaaagaagaaaacgaagaagcccattaaaattggtaaaatcttatcaaagaagctggtgttagcatcaccatacacataatgatttttaattttcggactagcttgagttgcgggcatgcttttggttttaactgattttttagtaactaaagctaacttcgtttgaagttcatttaaagcccggttactctgttctaaatgttttttaagctgtttaatattattcacagtaaccgcatttttgaacgccatcttagtagtggctgttctagttgcatcagtattagcataagttatattaaaattattgccgtctttttcaataattgcatctgtcttttcagcttttaatgctattttcgccgatttttctgaggcatattgatgaatttttacatgtttaattgtatttaaattttggttcagctcatgtgaaatacctaccgttcctactttcacatttgttgtaccgctattgttaaaaataaaactcattaatactaaaattaaaattggagctaaaaacattaacgctaaagttcgtttatcccgcattaactcttttaaaacacgatttgtaattgcaataattctcattattattctgctccttccgccttcaaaaagacatcttcaatagacggtacatcatattgttgctttaaatttttagggctatctaaagcaatcacgtttccgtccaggatcagtgctacttcgtcgacttgttcagcttcatccatcacatgcgtggtgattaaaatgctttgtccgttattttttatccgctttaattctcgccatattttccgtcgtaacgcggggtcaattcctaccgttggttcatccaaaatcaataacttaggattacccaataaagcaattcctaaagataatctacgcatcattccaccagaatatccttcaactcgtttattaagagcatcttttaaatcaactacttctgcaacatgatcaatttgcaattgtagttcacttgatttgatacctttcattttggcataaaattttaagttctcaaaaccggttaaggtcatgtacaatgcgtccgtttgggccatataaccaattttagataataatttacggtttggcattttagcctcaaaaatttctgcggtacctttatcagccacttccatgcccaacgcaattttgataattgtagattttcctgaaccagagggcccaatcaatcccacaatttgtccctgctgaacattaaggttgatattttttaaaacattttgttttccaaaacttttagcaatattttttaactcaattattgatttattcataaaaattctccttaaccgaatttggtgagtaattactcacttactggttggagtataaaatatatttattttttagtcaataacttctaacttcatttgaagttcaattgggagaaaataccgtatcaggttatgctgacaaatttgtccaaaaattcggattaaatttgcaatctaccctaaaaataaaaatgctcatcgttatctttttgacaatacttttgatttgttatcgttaatcccactacatccggcttttgctatctttcgaattggtcgagttttcaaattaattcgcagccatcatttattatggcgttttggattagatggaaaattttctaagaccgttcatcggtttatctatacctcgggcttcttaaacctttttaccgtcagtatgattattttagttttaagctcgctcctttattctgtggtagaacatatttcatatccttcagccctatggtgggccattacgactgccaccactgttggttatggtgatatttcacctaccaccaacattggtaaatttattgccgcctttctaatgattggtggtgttgggttcattggtttgctcactagtacaattacaggattctttacttctgaagctgatacgcaggaagatgatatgaccaagcttttcaaaaaaatcgatcaacttgatcataaaatcgaccatctccagcgtcagctcaacctagaacgacgtaaaaatacgcgaaaaaaataaggattaacgttttgagacgaaattattcgcccagcgttaatccttatttttttaaattagctattattcttcgctacccattgccttagcaacaaaagcagcaattgcagcacctaataatggagccacaacgtaaacccagtagtgagataaagctgaaccaccaactaagattgcaggaccaaaactacgagcagggttcaatgaaccgccagttaagttcaatgatgcaataatcatgaatgctagcgttaatccaataattaaaccagcaaagttagcattaccatactttttacttgtaactagcaagataacaagcacaaataggaatgttaccaaagtttcagttacgagtgctggaaatgctgaaatttttgcaaaatcagtttgaccaagattgctagttgaagctcccatagcacttaggaaatacttaaccattcctgaagccaggacagcaccaataaattgtgaaataacataataaatagcatctgctccactgattcgcttattaatccacatacctaatgtgacagctgggttaaagtgtcctcctgaaattgcaccaacagagtaagccataatcgtaacagccaaaccaaaagctaatccaattcctaaaacgtcggctttaccaattgtaacagcggcagtaccaacaaaaacaagtacgaacgtaccaataatttctgaaacatatttcttcatcaataatctctcctatgcacaggcaaaaacccgtacgaaaattgtataccactttaaccattttctcaaataaaatgtattaatcttgagcgtatctttttcaattaggtatacatttatgatagaatattgatataaacgtaatcaggaggagttcccatggcaaaatttgacgtacatattatcgaccatccaaccgcaaaggaaatgcttgtagaatttaaaagtcaacgacaagacaacgtgcctattcttgaaaaaccaggacattacattcttcctgattacaagttaacacgtcaacgcaaagctttaaaaatccgtaagcatacctacttaactaagaaattccgctcttacgtggcattagactcagcaaacggtcacacgctctggatgcgtaattttggtagtttatccgaagccattttttggctagaaactggtatgaagattggcgatactgatacagatgcgcgttattcgttcaaggagtggcaagaaaaacactttgaagacattgaaaaacttaaagatcaactacgagcaaaaactaaagctagacaagaaaacaaataacttagatgcaagagctgaggcaatttaatcaaccccaatcttgcattttttatacccaaaggagatttcatatgactacagaaaataaaatcttaagttcattatcatatttaagtatcttttttatgcccattctctttcccatcgtcgtatttgccttaacttctaacagtaatcaccctgaagctcatcgcaactccattactgctttttggcttcatttattaccaacaattttagttccagtggccttcttcttaggattattagcaactgggaaaagcttttctactgctaatttgagtgggtcttccctagtattatttggaatcgtcggtctcattggattgttgattttaggaatgtttatttacaatctatatcgcggagtaaaggtctgggtggactaggattattgtccttcaaaaaaattatatgtttttttgacttatttgttgcaagcgcttacagaaggtgttaatatactaagtgaggaaaggaaaagttcctttctaacaaaaacttctcaagtgcctcggttcttaggctgtcagaatctagtggaggggcaaatcagagtaactattgcaaatcgtttccatcatgggtgtacgatgtaaggttttgatgtttaaaagcatcgatgttttaaagtgattacacgcgatggtttcgttggtagttgcgacagccagcttctttaaatgtatgaagtgtaatgttcgaaaagttctacgtcatttaaacattgaatcaagtaggtgtgtccgatgacatgagtaagttgtctaaatgaagacaagattaattagtatcaaaaaaaattagttcaatggaggtctatcgtttcgaagaatatcttaatgaaactccaagaccgtctatttcaccgttagcctgaaacagtgtatacctcatcagatttagagtttgattgaacgatacaacagcagacgttatcaacagaagctcaggtaggttagaagcacgacggctgaacaatttaatacgtttttgtaaagttgaaggtgtaaagatcgtaaatttttccaataaagagattgtcgttagattgggacatctttcctcataaagggattctagtgtgagaagtctagaatcctatttttgtgctctcaaataaaaaacaggaagctcaatcgcctcctgcaatattattgttccacttttcttcgtttacgccctcttccaaaggctaatattaaaatagtaatccctactgctaaataaccactccaccccagatggacgttattaaacattcctggaaatcctgacgtttctgcctcatttttataaataatatagaaagtatacccataagcaattagattaacccaactaccaattttaacaatccattgcgatttaaaccacgcacctaaaataattaatacggggcctattagtaacgcaagcaataccttttgttgccctaaagtttttagaatgctcaataatgtagttggagtgctatatcccgctactacggcagaagcaaacggtccaatataagtagaaatgattagcaatatcgcaccagcgattaaaagtttactacggagtggatgtcccacgtttttaggtttgggtttcacttccgcttgagctgaagtcgctggatcagtaaccatcgtttctgattctaaaacatcctcgggggcttcgaagtcttctgcttctacgtcggagtcacttctagtcacagcttctttacgattttttttatttttaagaccgtgaatccaattagcaatcccatttttagctttctttattcccatccgcaactttaattctgcctgattatcagttggaccaacctttaaagcatagagataaccgcacaaaacaatcagaactaataaaccaatacctacaattctattgagccatattaagactactagagcaatcacaatcggtaaaagtgaaactaacggattatgtttcacccaaagaataaaattcttaatttgtgacaaccactcagaaccggcatgggcttgagtacgtgagtgactattggtttcagcttcttcagtttgaggttcttcttcaatttcttccgcttcttcactgcgttgtttgtacatttctgtccgagttaatgttgaaggctcatttttggcttcatcttcaagcgtcaccccgcaattagggcaaaaattggctttcttaggcaactcttcgccacaattcaaacaatatttcattatccattcctcatttaagtctagttaaaattctttattttctactttaaaacattttttcacccgcttcaaagtaaccatagatttttagctatttaatagcaattctttatactttttaaatatttctattaaaatttaattcttttactaccaaaaaagacctcgaaaatagatttcgagatcttttaataatcactaataaaaattagcgatatctaaaactattctttttcaatactaaaacggttgttgaatagcggactaacaggcttgttttcatgaatcaagcgaattgcttcaccaatcaatggaccaaccgaaatgctagtaattttgtcaatcttcttctcttctggaagttggatagaatccgttacaattaattccttaattggagaattttggattctttcaatagctggacctgaaagaacaggatgtgtacaacttgcgtatacttctgtagctccagcatccatcaaagcttgagctccaagtgtaatggtcccagctgtatcaatcatatcatcaatcatgatacaacgtttgcccttaacttcaccaatgatattcataacttcagcaacattggcgcgtgggcgacgtttatcaataatagcgattggtgcttttaaaaactcagctaacttacgagcacgagtaacaccaccatgatcaggtgatacaactacagtatcctgatcaagaccacgttcgatgaaatggtctgctaatagtggggcacccatcaaatgatctagaggaatatcgaagaaaccttggatttgtgctgcgtgaagatccaatgcaataatgcgtgttgcacctgcacgttcaatcatgtttgcaactaatttagctgtaattggttcacgtgaacgcgccttacgatcttggcgagcataaccataataagggatcacaatgttgatagtcttagcactagcacgctttagagcatcaatcatgatcaacatttccatcaaattatcattaactggagcagatgtggactgaacaatatatacttcgtctccacgaatactctcttcaatattaattctaatctcaccgtctcggaatcggtccaccgacgttttcccgagttctacaccaactgccttagcaattttttctgctaagggcttgttcgaattcaaagcaaaaattttaagctttggatcggaataatgttcagacatgtttgcctccaaaagattataaaatattaagtttattcagtttttccatataatatcataattcattttgccccctaaaagcaagttacttacggttggtttccccgtttttgtgttataaaattgcttattttaaaggaaatacaaccgtcgatgtcaactcagactatatttattgatttaagttaacgaatattatgcttttattgttcttagcaactgatttaactaaaacacattcaaattataattttgttcattcaaatattcttacacacattaataaacaccatatattgacatttaaatacgacacccactataattagtaccttgatgttattggagggatagaattgaaaattacagtattttgtggtgcacgttttggaaaccaaaaaaattatggtgaaacagctcgattaatcggcaatgaacttgccaaaagaaagattgaactagtctatggtggttctacatctggaacgatgggagctattagtcaagccgtacttgaaaatggaggaaaagtgaccgctatttatcctgaggggctatttgaagatgaacttcctcaaaaaaataccacgtcctttattcaaacgactactatggctcagcgtaaggagctattaattaacagtggcgatgcctttttaattcttcctggaggattaggaactttagaggaactaagccagctattatcaaatatggcgctcggtatcatccctcaaagaaaaattggcattctaaatattaatggtttttatgataacttgattcaactattaaataattttattgatgctaaattcatggatgcattacgtaaggatgatttactgattagtgctgattaccaagtcttgctggaagaattgacagcctcagaaagtaaatcgactaaacaagaacttagtgcataatctaaatttaaataccaaaaaaaggattgccatgatagccaccctaaaagttagaatttagtctaacgcttagcggtcactatcactatagcaatccttttttattatttattattttcttcttccgcttttaatgccgcatcgtaaactggaagctttttaaagtagccttctttattaacttggcgtccgcgggcaatacccatttcaaacttattaacgtcgttcgtaatggttgagccggcagctacataactgtgatcagcgatggtaactggagcaacaatgttagaattacttccaatgaaggcataatctccaactgttgagtgatgtttattcataccatcgtaattaacaaatactactccgcaaccaatgttaatatctgtaccaagatctgcatctccaacgtaactcaaatgccccattttagtccgtgcacctaacttagcgttcttaacttcacaatagttaccaacatgtgcaaattcaccaatctcagcttgagggcgtaaatgactgtgtggaccaatgttactatcatcatgcatgatggcactttcaatttgtgatgaagttaccgttacacgatctccaattgttgaatcaacaatcttcgaatgcgctccaatcactgaactagaaccaatcttagtattaccttgtatttgaacacccggttcaatgatggtatctggaccgatttctactccataatcaatgtaggtattttcggggtcaatgattgtaacaccattaaccatatgttcttcgttaattcggcgttgcataaccttagtagctttagaaagtgctaaacgatcgttaactcccattgattctgagaaatcagccatttcataagcagcaacaatttcgccagcgtctttcatgataccgattacgtctggaagatagtattcaccttgggcattatcgtttttcacttgatgaagtgccgcaaaaagcttttggttatcgaaacaatatacaccggtattaatttccttaatttctgcttcttcagtggtagcatctttctgttctacaattttagaaacaacgccaacctcattacggacaattcgtccatatgagaatggattttcagtacgcgcggttaaaattgtagcagccgctcctttttgacggtgatattcaaaaagattttcaaaagttttagctgtaaataaaggtgtatcaccactaacgatcatggtcattccatctttatcacctaaaattttttcagcttgtaaaacggcatgtcccgtacccaattgttgttcttgaattgcatattctgtacgatcacctaaaagttcacgaaccttttctgccccatgcccaacaatggtaacaatatgatccatattcgttttttcaacttgagttagcatatgatccaccatggcttttccacaaacttgatgcaaaactttatatagttttgatttcattcgagtaccttgacctgcagctaaaatgattatatttttttccattattactagcgctcctcaatatccttaaagtttctttcaaaataatttccggccttaatttggacctgtccatcttgagatgtatcgacatttaacaaggaagtaaagtcttcaatcgcacgttgtcccttgtatgtaccttctgcgaagacggcaatgccggttaattcagcttcaaattctttcagtaaatcaaccatggcatgaaccgtgccgccacccttcatgtaatcatccacgattaaaactttcattcctcgttgtaaactacgtttagacaattccattttttggatacgttctgatgaacgtgaaacgtagttaactgaaatagtcgaaccttcggtaatcacggattcatgacgcacaataataaatggaacatttaaatagttcgcaaccgcttgagctagtggaatccctttagtttccacagtcataactgcatcaacatcagaacgcatatattcgctagctaacattcggccaatggcccgtaaggtactgggatgacctaacaaatcagacatgtaaagatacccaccgggtagtttacgacttggatccgctagttgttcagttaactcatcaacaactttgtgagcctcctctgatccaattcccggaagatatttaataccaccagcagccccattagtaatttcaatggttcctagttgttgtttttctaaagttgatttcataatggataaatcttcgctaatagaagatttagcggatgaatatcttgtaacaaaaaatccagaagttatgagcgttcttggatgattgattaaatagttcgtcatatcaatcaatcgttcacttcgcttcaatttcattggtttcactccactcttcttttgcgtattattcgcaaaaaattacttactttttacttaccaatgaatataatatcatagttcattaataatgttcggatttagaccaaaaatataataaaaagactgaatcgtttaggattcagtctttttaattaatcatctttttttataatcatcgaaccaaaatagattacacattcaattagcgcaataaagaagctgactggccaattagttacatagcctaaatataaacctaaccagactccaattaaagcggcgctaatcgcaaagagcatcattccacttaccgttttggcaacaatcttagccgcagctgccggcaaggttagcagtacaaaaattagcaatgagcccacaatttgggctgctgtactaacactgagcgctaatacaactaaaaataaaattgaaacaaaattagtatgaattcctttgactgaagctccgatatgatcaaaggaatcatattttaagggccgatataaaaataaaataaatactaatgaaatgatcgttaacaacagtacctgattaacttcatctcgcccaattccgattacactaccaaacaaaatatttgtagcatagctaacatttttattggaaatcgataagaataaaattcctaatcctaaaaataaacttgaaactgccgaaattgcagattctcgtttggaagcttgtacactcattttaccgattaaaatcgaactaacgattgtaaataatagcatgccggataaggcttgccatcccataaaaataccaaaagcagctccagaaaaaccaatctcagataacatgtgtgataaaaatgacatgttacgtcctacaacatacacacccataattccacaaataatggcaatgaaggtccctgcaatgtaggcattttgcataaactcaaaactaaacatctagcaagtcctcctcatttttaatatcagctacttctcccaatgcgtagtgatcttcttttagcatcaaataacgattggagtagcgttgcattaaatcaaaatcatgcgtaacggaaattacggttaaatcatgctgttgattaaagtgttggactaaattaaatagttcatatttacgaactgtatctaaactagctgttgattcatctaaaatcaataaatctggattatccactaaggcttgtgccaaataggctttctgtttttgtccacccgaagctcgcccaattctagtattttgaatatcaactaaatcagtttcttcaagaatttcatcgagttgtgttcgttccattttggatagccacggcatttttccgttttgtaaatttaaggctacgaaatctcgaatagataagggataatctcgttcaatattcctaaattgaggcacatagcctaccttcgtccctttacgaaatttgatgctaccactcgtaggcttaacttgattcagtagtgcgcgaatcaaagtcgtctttccgaccccattttcgccgataatgcttagaaagtcacgacgatctacatcaaaactcaaattattaaataatttttgtcctggaaaatccattgctaatttttgaacctgaacaagcgtttcagtcattaatttttaccctcttgtattttactaatttggtttaactgtgaaagcatccacgtttgataattttttcccttcggcatcgtctctgtgacgtttacgattggagtatcgtttttcttagctagctttagaagctcatcgattactttattaccagtttgttgattatttacaataaattcaatccgtttttgtttcacatctttttgtaatttttccaccattttaggcgatggatctgtttcattttcaattgctaaagcgaaagctcggtcgctaactttatatccgagctcatccagcgtgtaatcatatactggctctgtaactgctacttttttgccagtactttttgctctaatttgatcaatcttttgttggattggttgaagtgattcaacatatttcttagcattttcggtaaattctttttgatgttttggatcctttttccctaatttcttagctaaatggttagctaaggttttcattgttgataatttataccacaaatgtgggttatcaccatcaactttacccgtgagtttccccatatttaaaaccttaagctgctttttttgaggagtaattttttgaacccaagtatctgttcctactccattttcaactacaatatccgcgtcggtcattaatttagccgtcttagttgtcggctcaaaatcatggggatcaactgctggattatcaataatgttggtaacctgcactcgatttccgccaacctttttagccacttctccataaaagttaagtgtactaatcacttctactttgccactggacttacttttaggtccagcacatcccgcaacaaaaatagtgctaaacaataacattgacactaaccaaattattttttttcgcatttctttctcctaaagagtaataattactatttacaataattaattataacaaaaaaattttaatatgggacgtctaattttaagataacgttttcaaaaatggtataatgatagtattaatcacgttttgggggaactagtaatgagtaattttattctcgatcaacaataccaagaagaaatttatcaactatatctatatgcatttaatgcgcaagatagcgctaaccgtcgcgatttctggaatcgtcgtttccaacacgctattccctatggaatctccgttgacggtcaaattgaaactagtattttaagtattccttttgaaacaaatttttttggaaccaattttaaaatgaacggtattagcgatgtgatgagcgctcccgaagcatctggtaaagggggcgcgagccaattgatgaaagctgctttacaggatatgtatgacaaccaggtaactttgtcctacctcgcaccatttgctttcagttactatcgacgctttggctatgaacaagtttttgaccatgttacctacactatggctagcgataaattaccacgtatttcaaaaaataccgaaaacgtccaagttaaacgccttgactttagttcaaatactgatttactaaaatcaatctatcaacagtctccactagctcaacggggaggtttaaaccgagccgattggtggtgggattatctacctaaaaaatttgttaatcgccaactggccgtagcttttgaacatcaacaacctactggttatgtcatctacgaacgtaccgctagcgaatttatcatttacgaagttgctaacaccgatattgaaagtcgccaagcactttggaaattcgtcaccaagcatggaactactgccgaaaactttatctatcaaagccctgtcgctgatatcgattttgatctagtcgacgaaccttatagcgtgacaactaccgtccagccttatatgatggcccgaattgttaatttgcaagacttcttagaaaagtatcctacatcaactccagctaagttcaccctggatgttattgatgatgtcctttctgaaaataatggacattggacttttgaatttgacggaaaagtacgttcggttcaaaaatcaaatgtcccattagatacccataccgcgattacaatccaacaattaactaaaattctttttggatatcgctcagcagcatccttggtaggacatggaaaaatcgccggttggacatcagataacgtaaaaaacttagatgccatcaccgtgtctcagaaacctattttggcagattatttctaattattgctaaaactattacttcaaaaaaacaaacatctatatttaacgatgtttgttttttactacctcggtgccatttagtgttaccataatttgtaaatagttttaaaggaaggattaacgatggactacaacatgccttttttcgaagaaatcatgcaagatcctcaaaatgcaatttatactgctaaaggatggcatccaatttatagtattaatccccaagcaaaaattttaattgtgggacaagcccccggaaaaaaagtccaagatacggaaattatgtggaacgaccaaagtggtgatcgtttacgcgcttggatgggaatttcacgggatactttttataattctggtgatattgcggtaattccaatggatttctattatcctggtaaagctaaaagtggcgacgttccgcctcgtaaagaagttgctgaaaaatggcatcaaaaaatgctggatattatgcctaacatccagcttactctgttaatcggatcctatgcgcaaaaacattatttaaatgttcctcgctctaccactacaactaatctggtgcaaaattatcgtaactttcttcccgaatactttcctttggtgcatccttcacctcgtaacaacatttggctggctaaaaatccttggttcgagcaggaagttgtgcctgaattacaaaaaatcgttcaaaatatccttaaaaaataaaaaactttcgaaacagttcccctgtttcaaaagtttttttattttaatgaaattgcattccaccatctacaataattgtttgtccagttacataatttgaatctggtcatgctaagaatgatactgcagttgccacatcttctggttctgacaaacgtttgcgcggcagtaatgaacgatttaatcggaacttacgctatttttatcctaaggggacttattttgagcacattagtgctcaaggcttgaaaaccaccttactcgaaattaaccagcgaccacttaaaatacttgactggcaaacaccttatcaggtcatgctgaccaatttgtcaaaaaattcggattaaatttgcaatctaccatatatagtgataataaaatttaatttcatgcgatatagagtccctttttccttaactggatcaaggaggcttttttgtgttgatagtgtataattgtatgtattaatagacgtacaaggagctgagacgcgtggaagacgtacaggagacaaaaagacaatttaagacaaagacagatcttgctaaaagtttaggcattgggtctcgtcaaactttgtataatagggccgagagaaatggaatagatttagacaagctaagtttcactgaagaagagttgtctatattgtctggtaaaaagacgtccgttacaactgaacaagccagtggacgcatgatacaagacagacaggaaaaggaagctctgaaagccctaaaacgagaattagagattaaaaataagataattgataatttagaacaagataaagcggatctatccaagaaactagataagagccagcagctacaagaccagcaacaacagttatccttaaaagatcgtgcagagttagataagttgaaaatcgaactcgataagtacaagaagattgaaactgaagaagtagttatacagcctagtgaggcaaaaaagacgcctacaaatactgataaaacagtaaataagacgtcaaatgtacaattagacaaacaagaagacaaacctaaaaagcattggtggaatatcttcaattaatcaattggtatataaaaatgaattttttaagattttacaaatttgaattttaaaaatattgatataacggcactcttaagtagtattttggctataccaattattttgataaaaatagcttaaaaataatcagtcatgtagcgaagttttaataaggatcattatgtcaactagcttttatctgactttggtatagcttagtttgaaacgacaattataactatttagtgcggatttagtcagaattaatggttatttcatatccagtgactttgacaccttttttaatcgtattcaaaacaatagtgacatttaatgtttcaattaattcatctacggccacattcaaaactttttgtttgaatcgtccagctgtccaattgctcgaacggtcaactcctaggaaccaatcttgccaatcgttcatttcaccagtaatcgtaactgttttctgattacccattttctgggcttgatacattttcataaggattagagtgtatttagacttaattcgtgataattctgatagatggaaagagtagtatttctccctcaaatcaaagacatagggtgccacatgctccgaaaacttaaatgtaatcgttttatttttagaaatacgaatgaaattaaataattgggtcattagtacgctatcggaaccatcttcatctttaacaaggaaataaagcggtgtttcttcattcagcgttttaaatcctttgattacacgagtatagttagtgccagaatctgttaaaccaaagtgtttcagcacatctgaagcttgtgccttgaaagtgtcgtccagtttcgaatcacgtgtaacgtaactaaaacagaaatctagtaatttgtgttcaaaagcttttaaattgccgaatgctttggctaagtcgttcccttgagtaaccaaataatcttgtcggcttagtaagtttttagttaattcattggttttaatttcaactttttctttcattgtcttaaccgcctttttaactttaatgcaattataaccataaatgcaaaataatgcaaatacagttaataaatccgcactaaatagttataatgtccgcactaaatagttataatgtccgcactaaatagttataatgtccgcactaaatagttataaagctatgctgtatcccttggtatgactgcatttttattcccttaatgtactataatgtatttaaatgtatttataaatgtataaacttatagggctagcctaggttaaattacaaataataaacactaaaggattaaaaaacgagaaaaaaacttcaagaattagaccacgaaaaaagatataggtttacaggatttgtagaacgaccaggtaaaaagagagaaaacaatcattggaaaccaacattgctattaactaatttaatgattattaaataaaacgtatattttatctacataaatcttgtatatacataatgtgagcaagggacgtgaccctttgcccccgtgttaggttatggttggctagtcgtagtacggaagcaaagtttctacaaaactttggctttcgccatttcagtgttaagactggtttagagctgtcaattccttatgctcccacgctttgctcgtccgctaccattgacagcaaacagttagtttttctgaatcttaacaagaatttagcggctatgttcgtttttaagggccttatttttcgtttttagcggttttgagactatttatataatttataccaaagcaaaaacaaaaagccctcaacaggctcttagagggctaaataacgaagccaggatgattaataatatcttcttgtcttttttgcaaaatataagtgtataaggaatcatacaaattctttttaatctcgtcaggttcattgacagaagcttcaaaaaattcttgaatatcaacttgccaaggatcagcaagcatttcatcaattggttttaatactttctttgactctacaattttaagtaccgatgttaaatccatcagtacttaaaattgtagagtcttactatctagttggcatctttagctaggctatttttattcactcgtgttttctgtctttggaataactaataacatctcgtaagtagttatgtgctttattaatctgagctagaaatggttggtcatggataaagttccgaccattttccaagtgccgtaagtacatctctttatacggtaattcttcattgcgtgcccgattacgttcctcttgcatatcccaagctactctccggtaatcaagatcagcaattcccccatcatcaacagtaagcaataggtatcgagctcggaggttggtctgatgtagattccagccatcataaggttctcccactgaaccagggttaagaattaatcgttcctgactggtataacggtataactgatggtggacatgagcgtagatccccacatcataatgttgcgacggatccatgatctgatccattttctgttgatcgttcgttggaaagaggcattgtcctgaattactttgtgggaggttatgattcaaaattagacgtaatgcgccgacttgaatactagttgtaattggccacttcgccatctcttgaataacatccccgccaacttcatttccgatacattcaccaatccgagaaatcataatttttgtttcatcatcatacgaatgagcgccatcataagcctgaatcaaatcatcatcccagtttccccgaagacaaatcgtcggctttaacgactccaatagttgccaaatgttaatggctccaggaccgggcataaagagatctcccatgaaccagcattcatcaacctgttgcttaacaatgtcatctctgaccgctttaaatgctgtgtagttaccatgaacatctgcaataattgcgattcgtcgttccatatttgctgtcacttcccaccatttatctgacttcagtataattaattttcttccagatgcaatttggtaaaatttactaaattttatgtgcaatcgactgcatagtaagcatacttaaagtataagtataaaacttttaatatattcttttatcaaacttgacagcggtttcactattgtctattctaaagctggctcatttgtgaggagtgagttaagttatttggaagaagggttatctaatgattaattggctattaccaagtgcgccaagtgacaaattagttccaaaagaacaaatgcacggcgcttttattaaatatcggaccagaattttggtcagtacgattttagcctatgcaagttactacattgttaagtcaaactttacactttcgtcaccatatttgacaaaggacgttggcttaactactgctgatattggactggtcctatcagcactcgcaatttcatacggaattggtaaattctttatgggattacttgctgaccggttaaacccccgttactttatcggtgtcggccttattttatctgcaatttttaatactttctttggctacacccgaagcttatgggtaatgatcttgttaatgatcggtatcggtttaacccaaggaattggtgcaccatgttgtcaaaaatcgctagctacatggtttgatgaacaccaacttgggaccgcaacaagtacgtggaatacctcacacaatattggttcaggaactgcttccttaatcgttgccggaacggtcggcgctttcggtgcggccaacattcatagcattttcttaattccatctctgatttctgtcgtaatggctttaatcgtaatggctctgggagttgatacacccgaatcagttggtctccctaaggttaataagagtaagcaaaagaatatcaagcataagacctcatggggtgccttccgtgataatatcatgaagaacccaattgtctgggcactttgcatcatgaacgcattctcgtacattttacgttacggaattgaaaactggatcccaatttacctctcaacttctaagggattctcatcagtcgctaccaattcagcttttaccatttttgagtacgcagctattcctggaactatccttttaggtttactatcagacaagctccttaagggtcgtcgagttccaatcatgttggttacttcaagcattatcctagttttaattccattctatgcacttgcgcaaaatattgtaattatcgacattattttgggtatccttggaatttgtatttacggtcaacaggttctaattggaattgttatcatggatgccctccctgttgaatcaattgcttctgggatcggattatcaggattcttcggatacgcctttggtgaagtaattgcttcatatggaattggttcaatcgttggtaagactagctggaatgccggtttcggaattgtggccgtttcttcaatcgtatgtataatcttctttatcttcttgctaaagaagtatcacaatacactatagaattttaattttgaagctggaaaagtattttattatttcctagcttcttttttattccgtctcttcgtccatcttaatgactcctaacatcaaaataatgctttcagtttagatttacagatcttacaacaccgttattcaaaatttgttaccaagcttataaaaattctctgcacaaagcaattaaaaaattttggcttaaaacagcgtaatctgcaacactttttaaatatttaaaacataacaatcttagttaggtgcaaacataaattgaattaaaaatacagtcaattcaacaacagcagaaattgattttatggttatcagcagatcgagtgaaacgaggtcaatgcgcacttacacatagaatttattctatgttgtgctaggcccattaaaagcctgtatcagaagtcgccgttggcgacaacaaaatcaaaaccaatttacccaaaatcaatttggttcaacatgttttctgtacttgcttgatccaagcccaaataagctaaagtcatggcttcacttgagtgatttagtaagtgcatgactaggccaatattgtaatttgattgcgtgtaaacacgataagccccggttttgcgcatcgtatgagtacctagataattaattcctaacagatcgccaaccctactcataattttgtagaactgtttttcagtgatatggcgatctgggtgttgaatggaaggaaagagccattcagatgctagtttatgatcaagcagccattgacgatacaataagagttctgtttgaactggtttaaggtacaaggtattaggcttaccagtttttcgatcatgaatgaacgcattttgtttaatagaaccgtccagattaaaaatatcggtctgttttaaacccataacgtcactcactcgcagtagcgtagctttaccaacttgaaaaatcgtatagttacgtcggccagctttaaagttattgagtaacgtatcttgaacctctttaagaacgtttgaatcttttatgggtaagacaacttgttgcatgtaaatgacctccagtaagaatatttgcattgtgtatctacacgggatatacttgacttgtaataataatttaggaggggaaaatatggaacttattaaagaacaaacacgcttagcaaagtggggaaactcgaaagctgctagaattcctagccaaattattaaacaactgaaattagatgataaccaagatatgacaataaccattgaaaatggatcaattgttttaacaccaataaaaaagaacccaaccaatattcacgaactatttaaggattggaaagatgacgggaaaagggatcacgagcttgattggggaaagtcagaaggcaatgaacttcaatggtaagccaaggtgatatattttatgttaactttaatccaagccgtggtcatgaacagatgaataaacgaccagccattgctctgagcaatgatctagtctgtcagacaagtaacatgacgattgtggctccaattagcagtaccaagcgtaattttccaatgtatcatcgactaactagtagtcaaacagtatatggaaaagtattattagatcaaaccatagccttagatttacgggcaagacatgtcactgatgaaactattgtcgatcatgtatcgcgtgaagaactagaagaaataatcactttgtacaaattattgtttagtattgatgacaaatagaagaagtcatttctttaatattaaaacaaataacccccaatatctacattatagatattgggggttattctttcaatgttttcgaggggcgatttgtatattatagaccctaaaatgcaacacatagttttctatgctagcttctcaatgtcctatgtgtttttgtatcttatcggcctggcacaagttatatcttttttattttacaatctaccaaaaagcgagtttaagctatgaaaaattatcccagcaatattactcggcaacaatttgaattaattcgaccagctttagaaaattttcgtaagcgaactaagcctcgaaaatatgacctctacgaggtcttctgtgcggtcctatatgtcttgaaaaccggttgccaatggcgtcaagtccccggtgattttccagaatggcggtcagtttacaactattacaaaatttggtcaactaaagctgagcctacggctgattctttattggaacaagttttaaaaaaattgtcattgctcggcgaacttaccaaggacgttcagctttaacttcctttattatcgttgacgctcagagcgtcaaaaacaccgctactgctgaaaacaaaggttacgacgctggtaagaaaatctcagggattaagcgccatctggcagttgatatcaatggctttccgcaggccattcacatgacgcgagcgaacgtctctgatcgagacggggccagtgcaatgatcgctttacatgccatgcatttacgccaggttcaaaatgtcttagttgatggtggttattcaggcgttaattttcagctcgatgtagccagtaatttaaacgcaaccgtgcaggttgcgaagcgcaatgagttgcatcgattcgaagtcatgccccaacgttgggtagtcgaacgatcttttagttggctagagaattgtcggcgactttggaaaaattgtgagcgtcaatttggcagaacaatatctgaaggtttcacttctttaccgaagtaaggcttcaattgggtattgtaatctttcacaaagaaactctgcttggtcaacttattaatttccttattggtccagttgagaagtgatttgttgcccttcttcacagccggagcaatgtaggacttaggcccaatactcttgatgccaaccgtgtagcttgggttatccttggaccaggcgtacaggtatgagttgtcatcggcaagggcaaccccacggccgttcttcaaggcgttaaactgctgcgtcttagaaccaaattttaacagtttaacatcaggctgcttggacgtgaaataattttcggcagtcgttcccttagtcacaatcacattcttacccttcaactggctggccttggcgatcgccttattcttaggtgaaaccacaccaacggaaactttcatgtatggtttggcaaaatcgataacctgtttccgttctggggtgaccgtgaagttggccagaaccagatcaactttgttggagttcaaagcatcaactcggttgttggcattgacttgaacaaacttagctttaactccgaggtctttagcaacctggtgggctaatgttacgtcgtaaccaacgcgcttgccgtctttgttgacccagccgtaaggaggtaggtcaccgaaaaccgcaattctaatggtcccgtttttcttgatctgctgaacggaacttgggttattgctttgcgaacttgacttcttactgttaccgcagcctgttaagaccagtaataaagcggcaaagacacttacaacggcgatgattctggtaaataatctttccttcatgaaatttttcctcctcaatattagaaatccatactatccaaaaatgcttgtgcgcgtttagtttgtggtgcgctgaaaaactgttttgaaggtgtttgttccaaaatatggccatcttccaggaaaatcaccctgtcagcaatctgctgggcaaagttcatctcatgggtcaccacgatcatggtcatgtgatcaacatcagccaagtcttggataatgttgagaattccccggaccatctcgggatccaatgaagcagtcacttcatcaaataacataaaatcaggatgcagggccagggcgcgaacaatcgccacccgctgtttttggccgccggacagttgccggggatatgcgttggcataatcctcgagaccgactcgttccaacaactccagaccttcctttttagcagcgaacttgtcctgtttttgcaccttggtcggcccgagtaggatgttatccatgacggtcaaatttggaaataggtcgtaactctgaaagaccatcccgattttttggcggatctgctgccaatttttttcggtcggattaatctgcttcccctcaaaagtgattgtcccctgccggtattcctccaggccattgaggcagcgaatcaaggtactcttcccagatcctgacggtcctaataacgtgacgacctcgcccttatcgacatgaaaattaatatcgtgtaagacgtgtttcttttgataatacttttctaaatgttcaacctgtaaaatctgctcagccatttgcccgctccaatctcttcttctctaatcgcttggcccaccaggatagtggataatcgattaggaagtagaatagaaatatcaatccgtaaacccagaaaacgccggttggatgagtgtgattattggcttcaatgatttgttggccaatattaatcacatccatcacagaaatcagcatcaaaagagaagtcgtcttgattacccgggtggccaaattgatagtcgccggaatttccaaactaatcgcttggggaatcaatacgtaacgatagagctgataacgattgagcccaattgccttgccggattcgcgttggtgctgtggcaccgagattagggcgccgcgaacaatatcgctcatttcagcagccacccacaaggcaaataccaaggtggccaattgatcgccaggaagattaaaattcaattggcgtggcaagatgtaatagaacaaaaatagcagcacgacggttggcacaattctgaagaattcaagatacagtctcaaaaccactcgcaatggccgattcttaaaggtcctcaaaacgccgagaataattcccaagatgagaccgacaattaaagccactgccgcaattttaactgttacccagaggccgccgagtaaccgctcaaaattagttccttcgaataaaacactaattcccgaatgatccatagcgaaccctcttttctagtaaagtcaaaatgattgatagtggaattaaaatgatcgcatagccaacaaccaagaccaatagatactcgttggaccggtaatacatgccaattaaatccaacgcagtgttagtcaattccggaatggcaatcaccgtaaagatcgaagtctccttgatcaaaaagataacattggcggccattgccggaacgctcagtgagaatccttgtgggaagacaatgtatctggcaagctgccagcgactcaacccgattgccttaccagactccaactggcccttggaaacgccgttgaagccgccggtaaacccttctgccatgtaactgccgccgagaaatatcaatccgataatgccacacaactcggcaccaaacttaatgccgatcactggaaacgcgtaatacaggaaaaatagctgaatcaataacggtgtgtttctcgaaacttcaacgtaaatcgatgccacttgatgtagaaccggtactttgaaatattgaagcaggctcacaattatgccaacaatgatggatccaataatcccgacgaaagaaagccacagggtgagttgaaaccccttctcaaacatcggtaagctctgttggataacggcccagctgctcattgtcaatcatctcctcacaagttattttgcagtcatttgaacacaaaaacgtccctgataaccagcatcagctgatcatcagggacgaattaccgtggttccacccttttttgcgttttgtcaaaaacaaaacgcctcatttcgaatgcatctttaattaaatgccacaactccgagcgcactttcggtcattgtctgcccgctctttcactatcagcggtcgctttgtgcagcccaacaacgtactcttctcttcaacattgtgaaattcaaatgactgtcaatcaattacctaataatgtaatgttaaacatctcaaaagtcaactatttttactaagagtccactctgattcgagacgcttaccatcgttataagcagcggaagtaatgatgtacggtggatcaaagtaaaataaagtatcctcgtcaaattggtccatatcaatatcagcaaatgaacccatggtcatatttcccatcggcatctttgttcgataattcatcaaacgggaaataacatcatcagtcagcccggaattaccaaccggaacgttaaaaccaccattcttattaaatctaatcatgtgttggaaactataaagtgttagtacaaacaactccatcgtatctcgtttcccaaatgcaagtgaattatagtgactccttagtcgaaggtaggcctctttattgcccttcgttaaaccatactcatgcacgatcttttgaatgcgacggattaagtcttctggttcttctaataataaactctggacaagctcgaaaacgacggggttcttctcgttatagaacgttctaccagaaccaactacatttccgccaacgttgaaagcaccaccggtcatgtccacaaaattagagatgtgtgctggtaacgcagcggtaattttgtccatcatcagatccttactacctgcataatttaaaggcgactttactatctcaaagtcttttttaaaataaatcaagacctcttgaagcttctgcccattggccttttgagatgcatttaggtttttatattctcggaagtcaattgtgcgcacctcaacgtcaccatcgacagcgaatttttgaattaagtctattaactcattcaatggaattaacgattgattactatagctgataataacatgggtaaatttcaattgtctaaccaaatcctcaaatgctactttcgcggcgttttttttattgtagtcagacattttccgctcaacacgccgacctgtttttccagtaatttttggcgagtcattgagtgcgattgtttccaaaacatgatatgcagaagcatactgagtcaccgtgtaaggtgtatcgatataggcaatatccccctcaatgtttcgaactagcttattagaatcatcgttatatgtcacgtttcgtttagagaataatggtagtttttccatagacagtggctcaagaatcaaattcttatttgatctaggctcccaatctttaaagaaagcctcgtaggttccagatgtgttcgatactctcataacactttcaagtagcgaagcaagtaagtacacccattctttctctgataacagttcagcatctcttaactcatcaagatggcgacgaattgtgtcaatcttaatggcgttcttttcttgaaaaaattttctatctccttttggagagaaatttaatgtgacgaaaccgtctggctctgttgaataatcataggtattccagtactcaaacggcgtggtattaaagtgatttttgaattttgtgaacttgggtacattcgagaagttaacctttgcttctgaaaacagactggcgtatcgcaaaagatcattagtaataatttcaaaacggtctttaaaatggtcggcaacgcttccagtcccagtaaataagtccgcaaaaacaccacccgttatatttttattctcaattaattggttaatctgttctaacaatcgagttttgttacctagatatctcataatcctctttactctctatttctaaaagatttaattagataataataacataaaataaatccgttttaaaggttgcccgacatgcatcttataaattaatcaccatcttatttttgccggatacacaaatatagccctgatttttagtataataacacgctgctataagttctctctgatatagtaaatttttttctggtgggaatggggaaactgttttagctttatgcatggccatgtttattcattacttaattgcgtcattttatacacacctttcagaaaaagggggcatatttcacaaataacgcctataaaagagcaagcatagaatcattgcttgctctttttgcatttcatcagcataattattttgaaatcaggagggtatttatgaaatttggtggtcgtctaaaaaatgcaagaatagaattgaatcttactcaggaacaagttgctagagatttctttattactagacaaacaatttctagttgggaaaacgaaaaaacttatcctgacattgccaacttaattaagttaagtgactactaccacatttcactagacattttactaaaggaggattctggaatgaaagaatacttggaaaagaaaagcgtggaaaaatctattcgtccaatattcattatattgcttatcatcgatttactttttctcacactacttatactcaaaattgttaatgtaattcagtttagtaatgatgttgttctgattctaaatatatttggcatcttaaatgctatcgctttacttcaattaagctcttttaaaatgaaaatgggtattaaaaataaaaaactaataccaaatagaaacctgagtttaagcataggtggaatattactcatagcaggaatgctatttcttttattaaccaaccatgttttgatcagtgggattttatctggaatgggattcgctattctcgtattttatttattttcgaaattaaattctaaactttcatgaaatattaattcgtactaagctttagggcctataagtctcaaataacccctcaaaaacattgaaagaataacccctaatatctataatgtagatattaggggttatttattttcatattataaaaataacttcttctatttgtcattttttcgataccttttagcacgattttgaccaggaaataaacgatcatgcgatccgactcgaattccaattaagactagttcatctttatcaatcgtataaaccaccaggacatcgttagtttcgcttggtgttttgtttttcggggtatctcgtaagtgaaattcattataaccgctcattcgccgattaagctcatgatcttcaaattctggtggtaattgttgttgctcaagcaacaggtcaatggctgctcgaacttcatcaataatagatttgtctaaactggctaaccgttttagatcagcattaaaggttgcacgtggtttaaatcttagttttttcattatttaaactgaccccaataatcatcatctgattcaacaatttcatcgtcaggtaaaacatggcgtttaattaactgatcacgtgcaattgcatattctaacgaaccttctttagcttttaatgctctttctagccagtccattttttcttgtgaaacgatggctactgcgcgactatttgaacgagcaatataaacggtttcgtcttcgtcattaacttgatctaaatatttttttaggttagcgcgaaaatcgctctgtgttagtgctaatgtcatatttaccaccctttcattgtacttaatattgtactttaatttgtactaaaaatcaattttttaaggagctaaaactatgcaacaagttgtcttacccatcaaagattcaaacgttctcaaagaggttcaagataccttactcaacaactttaaagctggccggcgtaactatacagtttttcaagttggtaaagcgacgctactgcgagtgagtgacgttatgggcttaaaacaggccgatatttttaatccggacggttctattaaacaaaatgcgttcattcacgaccgaaaaactggcaagcctaataccttgtaccttaaaccagttcaaacagagcttttattgtatcgtcaatggctgcttgatcataaactagaatctgaatggctctttccgtccattcaacacccagaacggcatattacggaaaaacagttctacaaaattatgagtaaggttggcgatctattaggaattaattatctaggtactcatacgatgcgcaaaactggggcttatcgcgtttacacgcaatcaaattacaatattggcctagtcatgcacttattaaatcattcaagtgaagccatgactttagcttatttaggcttagaccaagccagtaccgaaactatgttagatcaaattgattttggttagttttatttggatttttagttgttgccgaaggcaacttctgagacagattttaagcacaaacaccagtaattttaattgtggtgtgtaagtgcgcattgacctcatttcattcggttatgatccttgaaaataattgcttgtacatttcaacttttttaagatttaatgccattattttgtgatcttatggctatttaataaaatgactagtcattactgttttgagtcatacgattttcagaatagactagtgatttgattgtggatagatacgttaaactcgtatgtagataaaatattatgggttagtaagccattaatcatgttctgcgaagaaacacctataacgaataaaacgccataaaaagctccttgtaagtcttttatggcgttttattcgttacatacagtattttatatggatgatgcttaattgcgcttagaagcgcttatatggccttaaaacagcggtcacaaattaggtatggtcaatcttttgattttatttttcagcaggaaaaaggcgcagcttattataagttcatcttttatattttatatcttttgttcttttgcgtagttataaatacagtaataacaatgcattcacgtattatatagccacaaaaaactgtgtatatagccacaaaaaactgtgtatatagccacaaaaaactgtgtatatagccacaaaaaaataaaataagtggctatataatgttataataaaagcataaagaaattcccgtctagaagtttttctttatgcttatccaacaacacacccaaaggagtgtatttatatgactattataccggaatcaaagacaaggcaggtacagaccttgaatgaattatcaaaaagaaaagtcgttgaacataatagtttaatcacatccattgccaagatggataagacaccactcaaaatgtttgaactagcggtgtctttaattgataccgacaatccacctcaggatcagacggtttatttatcaaagaaagaaatgtttgctttctttaaagtggatgacaacgataagcatagtcgttttaaagaggcaattgaaaaaatgcaaaaacaggctttttttcagattaaaaaagaacaagataaaggttttaagtttgttagcattgtgccaattccatatgtagaatggacagattatcatgatgaggtattaattcgatttagtcctgaaattatgccctatttaattaatctcaaaacaaattttacacaacatgccttgtcagaaatttccgaattgaatagtaaatatgccgttattttgtatcgttggttatcgatgaattacaaccaatacgagcactatagtgttaaaggtggacgccgagaagaacaaattgacaggtaccgtaatcctgaaattggtatgaaagggttacgagaaatgactgatacgataacagaatacaaacgattcactcactttgaaacgagagtattgaaagaacctctagcagaaatcacaaatcataccagctttaatgttatatatgaaaaagttaaaaaaggacgcagcattgatagtattgtctttcatatcactaaaaagcaggtggcagatgatattagttacaagttagatgatccaacttatattgacggtaagataaggcaagaagaaagtgaaaaagacctcgtatatgaagctatgaaaagtccatatacaaaattgctgatggaacatttcttgttgtcatatattgatttgacggatacgtctattttgtcagggttacagaaaaatgtttatccactttatgacgaattaaaagagttacgtggtttaaagggcgtgaaagagcacttagcatatatccgagataaacaagatgactattcgaaaaagaatattgctaagtatcttaaaaaatcgattgaacagtatctaccaatcgttaaaaggcaggatatagattatgagtgaaaatttaaaaacaattcgagaactcgctgatgagttaggagttagtaagactgcaattaacaaaaaagtttcggatagcgaacgaaaacaatggttttcaaaaaacggaaaccggtttttggttaacgaaaacggacaaaaggctataagaacaatgttttcgtctggaatcgacaaccataaatcgacaaccgaaaacacatatcaacaaccagaatcaaaaaccgaaaactttgaaaacgccaacctaaaacattcagatattaactacttaaatgatattattaagtatcagaatgcacaaatagaagatttaaaagaaactaaatcacaacactttaagcaattgaaccaaatgcaaaatttattagaccaacaacaaagattggccttacaggacaaacaactgctcgaagaatacaaggcagaaattaaggacttgaaagccttaacgatggcaccgcatgatgatggtgaaaaagagatggcggtacaaagcaattctgatcaggaaactagtactatggggtcacaagtcaaaacaaaaaaatggtggcattttgggaaatagatccaataaaaaagaaaatagttgtacttctgtgtcaagaatatggcctgtttttattaagtctctgagtgtgcgaccttcttgtggatttttcacaaggtaacccttgaagtccatgtgagtaacgaatcatactaaaaaagctcctatacataatctatcggactatttttatttagtccgatagattatgtataggagcacactttacaatcttggataatcaaggtgcaactagaaagaacgcaacaattcgattggatcaacaagtagtaactgaatgtgttgactttgatcgttcccaactgaaatatcaatatttccagcagcaatcgtttgcaagctgccaataggccacgggaaaacaaaataattataacctcgttccaaattatctgaaattgcctgatagttgtacgaatattcataaaagaactgttttccaacagaataccaatcagcgggagctgttgcccaggtgtttttttgttgattgtttttgtagtaggtcaaatcatagtacttagtgtcatatatgtctaaatactcatgttcctgttcagatctaagaaccaaagcgtccggtatctgcttatttttagagataattggattactaccaggtaattcaattgaccaaacagcgtttggaattgcttctggtacgtgtaaattcacctgatcaccaatgaacttcttaaaactattttcaaataatacatgaaactctgtcgtaactattgatatttctgattggttcgtgtcaataagattcaaatagttcaggagactaagaatcaacatcttctcgcgcctgacgttcgttttgtttaacgttttgttcagtatccgttttagcttgattacgtcgtataagtcagcatgagttagtcgtgacttaaatgaaaaatcatgaaaaagtacgccaaatttttctgagatctgttccataacagaagcatgtattttggaaactatgtcaaattcggacactcgttttctcttaattaaatttaatagtactaaattatcgtcttgaacaaatggggttgtctttttgatagtccgcccccagttaatatttcctctgtttttgctccactgcgtatgactcacctcgaatataccatttgatcgaaagtctttaatcagccactcgactatgccaaataaatcattagctgaaatatcaatctcagtggtagtatcgcctgacttgtgggcgcgattgttccttagagaatcaataataacatttataatgtctgacggaacgtattgtgtccactccgagtttttaggtagcattacatttaattcattattatttagatgaaacccaacatagttgatcgtttcagcgcgattatcggtatttttcttaaagtattggcgcatataatctggaacttttactccatgtggagctctctgtccatccacccatattctttggctaatatttggcatttttatctcctacgggaagattgccttgtgtactatcccttttaaaagcgtctaaagtaagcacgtcgcttaaatggcgcgtcttcatgaaggttgcttgaacatccgcaaacttatattgaacaaataacccgtcggaataacgtgccgcatccgtccataagtaccccaataatttgtcaacgaaaacctggggatcagttatttcgttctctttgaggaagtactggccaactaaagcgtcctcttcaattttaacttcgtttagcaaatactcattgattgcttccccaacttgcttccaggtaaactgagaatctgccgttgctttattgccgtatgaaacagcatcaaaatcaattgacttgtactcagataaccaacgacgcttgaaggctgtatcaatttgttgcacgccttgatctgctgggttcatcgtagcgatgattgtcatgttaccaggtatcttgatccccgtatccttgaagttggtaaatccaagaacgcgctcgtccagatactcagcaagttccccgttaaaaacttcgtactcacttagtccgtttgaatcgcgatctaacatttgaaacacttcgccaaatacagaggctgcgtttgcacgatttaattcttcgataatcaacaagtggctattttcgggattattaaacgcttctaccagaacacgcgtaaaggcgccggggacatagacgtacttaacacgaccctcgaaatctctttgtggctttaaaccaccaacaaagtctgtgtaatcaaaatcattaaagaatgtaatacgctctttagtcccattgaacattggcgatagttttgaatcgacgtaaaaactttttcctgtaccaggagccccgtaaattagtatgtttttaccggttttgattggagaccgattgaaatcaaactttcgcaatgagattccctttcgaaaattaccgttgaaaaggttatttaaaaagtcggaaattgtgttttcagaagtactaagtaacttaccctcgtcataaatctcaaacgaaattttatcgaaatctaaactgggatgagacagcttatagtacgcaagaatcagtaacaatggaacaaataatgaggatccgatagatttattattattaccctttttgatcaggattagcccttgatcatttttttcaatccgggtgtcggaagtcttgttttttgaagatgtaacgtcattgtaaaattgataggctctttcggctgaggtaaaaggtaaaaacttaaatttactcgggaacatttcaatgatatcaaacccgatagttaccgctgaacggatcgcttcttgcatcgtcttaggatattcatctttatcttgatatacattcaggtcaaaagtgaaatatataagcttttgaggacccgactcataaaggtagtccactgtcccgtcttgtgcaatcttatctaatataaacgaattgaactgctgactaactattgtattacctgccttatcgctataagcgattaacacgtttgaaacaaactccccagcatcattgagaagtaccgtcatgtactctgaaaggctgttatcgatctgcaagtcgcttaatgaagcaacggtaacaaatggttccggaaaataatttgttgcagatagatcgctttgaaatttagtgaagaatgatgccaccgaatcagtatacttattcgtttttgaaattttctcgatattctggaaaaaagttggtttattacttttaaaattggcatcctcgtactttttcaatttgttccataatctttgacttattacagttctcatactatcctgcacctcattgtatatttaatgattagtatatcttaaatgcaaaaaattatcccacatataaagacgtgggataacaggttaataatttttaattaatacttcttggcgcggaaatctacgtccttcacggccaactgtttgcatatcgaagcctttacgttctacccaatctaacaacatttcatttcgctggcctttatgaattacggtatttgaaagcaagaatttacgaccggtattatcaagtcgttcaagataattcaataactcatattcatcacggtattatataaatgatttacgacaaaaagttgggaacacaccgctaatattgaatactgctacaggagcactttttaataatgcgggtgaagttttattgcaggaaagggtagatacgaaagattggggatttccaggaggttaccttgaatatggtgaaacatataaaaaagcaataatgagagagtttcaagaagatacaggtctatcggtaatacctgagaaattaattcaaaacacagatgatactttttataaatatccgaatggtgatcagatacaatctattaaccagttttttttagttagataccttgaaggaacattattgagtgtaaaaacaggtgaaacaaccagactaaaatattttaaattagatcaaccccctcaattttttaacgaacaacatgccgaaatgtttaaaaaaatacaacgaatgagagaataaactgatattccacaaattttgaattataaagcaatatctataagctttagacgtttttacaagaaacggagtgagttaaatgaacgctaataaaaaaagaattagtccatatgtaatattgatttcctgtgcagccgctttggaaggacttctgtttggatatgatacagcagttatttcaggagctgttgggttcttacagataaagtttactttgagtagcgcgcaagttggatgggttacgtcttgtatcttaattggatgcgcactaggtgtttcgattgcaggtattttaagtgatttatttggacgcaagaaaatattggcgctttctgcagttatttttgcactttcttctttaggtgctgctttcgcaggaagttatatgattttagtgatttggagaatgcttgcaggtattggtataggattgacttccttaataacacctttatatattgcagaaatggcaccgtcaaatgtgcgtggaaaattggtatccgttaatcaattagctatcacgattggaatttttattgtctattttgttaatgcagcaattgcgtcaaatgcaacgcaattatggaatgtttcaacaggatggagatggatgatgggggttggagtaataccatcgttattatttttaattgcattgatcccgactggtgaaagtccacgttggttatcacaacacggaaaatctgaggctgcttataaagtattacaaaaagttgaaataagtgatgaggctgcagaaaagagcttagaagaaattcagatgtctgaggaagttgttgatgatacaaaatttagagatttatttaataagacttggttaccagtacttattattggagtattgttagccttgttccagcaattttctggaagtaatgcaataatgtattatgctcctgaaatatttaagggtgcaggatttggacaaagtggtgcattcatggctactgtatcaatcggagtaattaatatggtaatcaccattgtcgcattaggtttagtagacaagataggccgtaaaaagttattaggatggggatcttttgcgatgtcatgttgtttacttgttgtttcaatttgtttctttgtacatgctgctactagcataacattgacttttgttttattagcaattgccgcatacgcagtttctttagctcctgtaacgtggatactaatttcagaaatttttccattaaaaatcagaggtagagcaatgtcaatttgcacggcagttttatggctaagtgattttaccttaagttataccttcccaattctgactcagaatataggagaaggatggacttttatgctttatgtagtagttactgcattgtcggctatatttgtatggaaattagttccagaaacaagaggtaagtctttagaggaaatcgaagtatattggcatgctaaaagtaaaacccatgtaaaataattttaggtttaaatgacaatttcttaaactctcatttgataggcaataaggtctcacataaagaaatgggatgggcgtcggtctattgtcaaacggatatagtacctggactacctcagaaattgaacgtcatattgggttacaatttcattttaaatcagtggcagatgatattcgttaatagttgtaaatgatgaagaatacagtttaatccataatgctttacatgatgattctggtaatgtgcttagcttttcccggtccaaaccaaaatcaaaaagtaacgtttaagttgttagattatatgataagtcatgcagatgctaaataaatgattatcctaagtacaataaaaaaggagaccaaattcgtaagtgaattggtttccttttttatttggaaaattattttttaacatgcttattaacttcttgggcgttaccaaatgaaacagttatgatgcgactgcgcattccccaaatgtagaaaataaatgccacaatgatgataactataaaatcaagaggataatggattaaatttctaccattaaaattatcactaccaatatacgacataactgaaagaaaaattaagtatacaatcagccagaggctactacgtagttgtttcatagtttctttccaatgtaatcgccattcgtaataaataaaaattggtaaacctagtaaaatgactaagataacttcaactgttgttggccacatggcccaataaatagctaaagaagctaaaatgaaagctaaaggtgccataaatttaattgcttttaaacgaacaggtcgattgaaacgggaagccatttttcttaatgatacgaccgtgattggcccagtcaggtaagcaattaacgtcgaagtcgagataacactggctaaagttccccatgatctaaaaatcgaaaccattaccatacttaaaacagcgttgaaagccatagctactcgaggaatcccatatttagcattaattcttcctaaaattttaggaaaatgattattacttgacatagcggccaaggcccgtccagttgaagcagcaaatgaaacaccagttccaaagggtgaaataaaagcatctaaataaagtaaaactgacaaccaatgaatcccaagtaagatagctaaatccgcaaagggtgattcaaagttaattccatgccaaccagattgagtaattagtgcagttggtacggaagtgatgaaagtactttgtagaactaggtagagtacagcactgattgagagtgaaagccctacacctagcccaatgtttttcttagggttttcgacttcatttcccatattaattacggtttgaaaggcgttaaaggaaaaaataatcccagaagcagaagtagcagcgaaaatcgaagctgatccgtaaggcataaattccgatagtgattttccgtaattttcaggatgaaagccacttaaagttaaaaatataatagtaattaaaggtacagcaattttgaaaatggagattaaactcgtaaatcttgttaatagagttactgaccaataatttaataaggtgaagattaaaatgaaacaaaaaactactaatagaccactagtagtgatgttcccatttttgaaaaaactatgggtccaattcgcccatgcccatggccaagaactcatgtattggaccgcagctacagcttcgatggggatgagagtgattagagaaatccaatttgcccaagaggcaataaaaccaaccaatgatccgtgactgtattgagcaaatttactcattccgccagattctggaaacattgtccctaactcaatatagttataggcaattacaccaatcacaacaaatccaattatccaagaaaaaattgccgctggaccagctactgaagcggcctccattgatccaaaaagccaccccgaaccaattagagaaccaagcccaagcattaccagttgaaaaagatttagttttttaataaaaaatatcctccttaatttttgattaataatggtaaatactaacgtatttgtgtaaataaatcaaattggtataggacgttccatatttttatttaaaatttaatcgcttatatggatctaattaaatgggtgatagggtaaggtttaccaaaaccatcgactggatcttctgaatcaattttaaagttattttttagatagaaacgttttgcttgcacattttgcgagtttacatcgattcttttaatatcatatttgcgtactaaagtagacaatatttctctaccgtaaccttggccaataaattgggggtctaaaaataacatgacaagctcgtctttatcgataccactaaaaccaaccacttcatgattttgatttttccagacgattaaatttactgaatccaaagcctgtggaatgatttccttgtaaaaaagtaaatctgattctttcaaaaagtggtgagtttttctaacggatgcttcccaaattttgagaattaaagggtaatcggatttagtagcggtatttgcgtttaaaataataacatctccttttattgttagagctccatttctagtatgtctaaatggtatcatacagatccgtttaaattaaatctaagtaaaaatgattttggatcatattacagtgtttatcgtatatatatttagtacaataatactaagcctatacatgaaacggaggagtttttgatggagcaagaacgaattttaattttaattaaaccagatggtgttagtttagggcatattggggaagtaattacacgtttagaactgaaaggatattcaattgatgcgcttaaagttacccaagcgacggaagcacagttgcagcaacattatgaaaaattagttaataaaccattctttaaggaaatcgaaacatatatgttagaaggcaaaatcgtggcgatgattgccagtggaactcatgttattgatgtttttcatcggatggcaggtgctacagatccgtcggaagctgccttcggaaccattcgtggagacctgggacgggagtggccagacggtttactacgtaatgtggtgcacagttctgatagcattgaaaatgctgaaaaagaaatcaaaatttggtttccagaattaaactaagatgtgtttataaaaaagtaaattacagaaactagttaatcgatgactgattggctagtttttttatataagagctcattatttttcagtagcgagagtaataaataaaattagataattaaacttcctttactaagtctgttcatcagtttatatttattagtcattagaaaagggggtctaattgaacatggttttgagtaagacaattgcaaaaattagaaaagaaaaaaatttaacagttaatgatctcatccgggataatatgtctaaatccagctataatcgttttgctgctggaaaagccgacattcacagccattacttcatcgagctactgaaacgtttacacgtaactttaactgagcttgaatatattgataggggatacgtacctaaagatataaatatttacctatccagaattaaaaattttttaacaagcgtgatgctaatgctttaaaaggaattattaaaattttggaaagtgaatattcaaaaattcataacactgaatatcagcatttaatcggactttgtgagattttgattgctcgtttaaatcactataaactggatatgaaccagaatattttatatcgatacttgattaacacgtcttcttggacgagatatgaaatcattttgttcaataattctctattttatattgaaccagaaactttgagcatcctattgagtaatgcattaaagcatgtccatgaattggatgatcttaacccacaagtagttgaagggtttagacttttaagtaacgccattatctctcttttataccagcaggaaccaactttggcgctatactatatttcaaaactagaagagtttcaagtgaaagaagagcacgtgtatgaaaggattttgttacttttttttaagggtatcagaaaaaaattagaaggttattctgaaatagagtataacaaagaatttaacaaattatattttattttagatgtactacaaatggaggagcaaaaaaggatttttaaaaatgccattgcaaaattataatgttaaaaatcaaaaataatcatttaaaacgaccgtgtagactaatttttaatgcctgcacggtcgttttttagaaaaataaaaagaaaagatgtctgaagtgtttaaagacgttacaacaaatggaaaagtaagaccttggcgagaacgcaaaattgaaaatgtacgctatgcagaatatttgtcgattttagaatttaagcgggcgcatgatattaaaaattgtggggaaactttacgttttaggaaaattggtgaccatttgaagctttatcaaacttggttttgtcacaaacggttatgtccgttgtgcaattggagaaagagcatgaaaaattcaagccaattaaaacaaattatagctgaagcagttgcaagagagcctaaaggacgttttttgtttttaactttaactgttaaaaacgctcattcagcagaggagttaaaagtgtctttaagagctttgactaaagcctttaataagctaactcgctataaaaaagtgactaaaaatttattgggttatttacgttcaacggaaattaccgttaatgaacaagatgggtcgtataaccagcatttgcatgttttattgtttgtaaaatctagttattttacaggggatagcgtgaattatattaagcaagaagaatgggctaaattgtggcaaagagctttaaagtctgattatgagcctgtggtgcatgttcaggcggtcaaggcgaataaacgtaaagggactgactctttacaagctagtgctgaagaaacggctaagtacgaagtgaagtcggctgattatatgacggttgatgatgagcaaaatttggcggtaattaaagacttagaatttgctttggctggtactcggcaaattagttatggtggtctttttaagcaaatcaagcaagatttgaaacttgaagatgttgaaaatggtgatttaattcatgttggtgatgaagattacaccaaagagcaaatggaagctgcggaagaagtcgttgcaaagtgggactttaaaaagcaaaattattttatgtggtaggggggtgttttttatgatgatgagattggataaattttttgttgaagaaatgcaaaaaaatggttttgatgttgattttaagcgattaaaacagatttatcttgattctagaaatagacattctgatgatattgaaaagggaaaagtacgtgctttaaatgagcgtttgaagtatgaagattaggagataaatgagtatgggattatttgaagattattacgatgagcatgacttagataaaaatagtgaatacagccatatgagtaaaaaagagttagtgattgaagctgaatatttgcataattctttgtggaatattttgaaatatgttgataacggcggtacagatatagatgttgttaaagcggaagtctatgacggcatatacgaaagtcggatataaacattgcatgtttagtgatttttggaattttgttccacggtttttgtggatcaaaaatttcggttttgcaaattaaaggaatctcggcggaaaagatagccgagatttttttaattcgggcgtcaatttttcttagaaaaattaagctagtgagtggcgattattttggtggaagagaacagccaaaattgtcggccacgagagcaagattttccgagtaggaaaatgagcggtggggtctgtcctgctggcaaagcaaccctcggtagagaccacactttgcgaagtaaagtatagtgttatactttacatggacggtgtccgaattagggggtgtgtggaatgagttttgttgtcgcaagaatgcagaaattgaaagctgataatttggttggtttgggtaatcacgaccaacggaaaactagcaatcatagcaaccaagatattgacgcttctcgttctcacttgaattatgatttggtggctggacggacgaacaattttaagacggatattcagtcttatattgacgaacgcaaggctggctcccgagctgtccgtaaagacgctgtcttagccaatgagtgggttattacgagcgataaggggttctttgagcaactggacgaaaaacagaccagagcctattttgaaactgctaaacagtactttgctgaaaagtttggggacgagaatatccgctatgcttgggtgcatttagacgagcacacgccccatatgcatatggggatcgtgccgtttgataaagataataaactgtcggctaagcgggtgtttaatcgggaagccctgcaacaggtgcaagatgagctaccagagttcttacagtccaaaggttttaagcttgaacggggtcaaaaaaacaaagagcgtaaaaatttgtctgtgcctgaatacaaggctatgcgtcaagaattagagacggttaaagcagatacaaaaaaacagagacaagaattcgaagattttaaaaaatctgattttgatgtaaccaatgttgaaaccttacaaccacgctttaaaaaaggctacgtgttggttaaaaaagacgattttgagcagatgaaacagggagcaatttatgccaagagtgcttttattgattcactccatgcaaaatctgacgctgaaagagctcatgatagtgaaattaaagctagtagtcgggcgcttgaattggaaatgaagaatgataaactgcaagatgaaaataacaaattgcggacacaattaaatcatgcgcaagatttgattaagcgtatgttcaaggtgctaaaagaaaaattaggcgataaagtgcatatgaaaccagaaacgtggcacaaaatcggcttaaaagctccaaatgagcctgataagcaatctaaaaagcgacccgagagaaatacaggcttgagccgttaaatcgcttagaacgcaaatatgagctaattagagctatatcatgctagcaatagagttctgtttagctgttagtcaacggtaaatcgaattaaaggggcttactgcttttagcagttagcccctttttgaggctttaaggagttgactgactttactcaaccaaaaagccttatgtcctaggaaacaagccattgtttcctcgagcccagcggcggcaagcgacaggggtccagctggctcagctggtcggtgtggctgaaagccacggttttaaaaaagacagtccagcggtttttgctgatctgtctttttggggtttggaagcgacgttttttgtcgctttcttcttatcttgatactagtagcatcaactagtttttagtgttttcgttcctatcccttgatattacagggttttggtgtattattgaggtataaattttaataaagaaagacaaaataaaaaacccacgtgaaatctctgtttggcgaccgagcacgtgagttgattatcatttacgatttatagccttattttaggggggaaaccctattatgtcaaggttgtaagcttagctaaaatgataattcagctccttcacgtggataaaacgggaggagctttttgcatggcaacgtcctaccctcgcagggggcgatcccccaactactctcggcgttaagaagcttgacttctgtgttcgacatgggaacaggtatatccttctcactatcgtcaccacactctgtgctaacttacgttatcacttgagaaaacttttgctctctcaaaactgaacaatatctattttttccttcgagattcaaccacttctacttggttaagtcctcgaccgattagtactagtccgctccatgtatcactacacttccacttctagcctatctacctgatcatctttcaggggtcttacttgcccgaaggcaatgggaaatctaatctcgaggtgagtttcacacttagatgctttcagcgtttatctcatccacacatagctacccagcgatgctcctggcggaacaactggtacaccagcggtgtgtccatcccggtcctctcgtactaaggacagcgcctctcaaatttcctacgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtgaactcttgggggagataagcctgttatccccagggtagcttttatccgttgagcgatggcccttccatacggtaccaccggatcactaagcccgactttcgtccctgctcgacctgtctgtctcgcagtcaagctcccttctgcctttacactctacgaatgatttccaaccattctgagggaacctttgggcgcctccgttactctttaggaggcgaccgccccagtcaaactgcccaccagacactgtctcccgccacgattagtggcgcgggttagagggttcatacaacgagggtagtatcccaccattgcctcctccgaaactagcgttccggattctacggctcctacctatcctgtacaagctgtacaaacactcaatatcaagttacagtaaagctccatggggtctttccgtcctgtcgcgggtaacccgcatcttcacgggtattataatttcaccgagtctctcgttgagacagtgcccagatcgttacgcctttcgtgcgggtcggaacttacccgacaaggaatttcgctaccttaggaccgttatagttacggccgccgtttactggggcttcagttcagagcttcgcttacgctaactcattcccttaaccttccagcaccgggcaggcgtcagcccctatacgtcatcttacgattttgcagaaacctgtgtttttgataaacagtcgcctgggccttttcactgcggctgatcttgcgatcagcaccccttctcccgaagttacggggtcattttgccgagttccttaacgagagttctctcgctcaccttaggatactctcctcgactacctgtgtcggtttgcggtacgggtagctaaactctaactagaagcttttctcggcagtgtgacgtcaggaacttcgctacttaaatttcgctccccatcacagcttgtccttaagaagtaaagcatttgactctacttcagacttactgcttggacacccttttccagctgggtgctttccttagcctactgcgtccctccattgttcaaacaagtttaactagtacaggaatatcaacctgttatccatcgcctacgcctctcggcctcggcttaggtcccgactaaccctgggaggacgagccttccccaggaaaccttagtcatacggtggataggattctcacctatctttcgctactcataccggcattctcacttctaagcgctccaacagtcctcacggtctgccttcattgcccttagaacgctctcctatcacgccacctaatggtggcatccacagtctcggtaatatgtttaagccccggtacattttcggcgcagaatcactcgactagtgagctattacgcactctttaaatggtggctgcttctgagccaacatcctagttgtctatgcaactccacatccttttccacttaacatatatttagggaccttaactggtggtctgggctgttcccctttcgacgatggatcttatcactcaccgtctgactcccggacataaatcgatggcattcggagtttatctgaattcggtaacccttgatgggcccctagtccaaacagtggctctacctccacgatcctaattccgaggctagccctaaagctatttcggagagaaccagctatctccaagttcgtttggaatttcaccgctacccacacctcatctcagcacttttcaacgtacacgagttcggtcctccagtgcattttactgcaccttcaacctggacatgggtaggtcacttggtttcgggtctacatccgcatacttatatcgccctattcagactcgctttcgcttcggctccgtctcttcaacttaacctggcatacgaacgtaactcgccggttcattctacaaaaggcacgccatcacccattaacgggctctgacttcttgtaggcacatggtttcaggaactatttcactccccttccggggtgcttttcacctttccctcacggtactggttcactatcggtcactaggtagtatttagccttgggagatggtcctcccggattccgacggaatttcacgtgctccgccgtactcaggatcctgaactgagagaacttgatttaacttacggggctatcaccctctctggcgaatcttcccagattcttcagctatcaagttctttggtaactcaaatgttcagtcctacaaccccaggaagcaagcttcctggtttgggctcttcccgtttcgctcgccgctactcagggaatcgaattttctttctgttcctgcgggtactgagatgtttcagttccccacgtttaccttcacacatcctatgtattcagatgcggataatagtcgattaaaactattgggttgccccattcggaaatccccggatcaaagcttacttacagctccccgaggcatatcggtgttagtcccgtccttcatcggctcctagtaccaaggcattcaccatgcgcccttcctaacttaacctatctttacctacggtaaagtgattaattgagtttagcgattaatctttgaactaatcttgttttataactctttaaattacgcggttttctctcggtttaattatgattaacaattaaaattagaaaattatagatattattcagttttcaaagaacaaaaacctctcaaaactaaacaaaactttgacatagtgtgggtttccgtttattccttagaaaggaggtgatccagccgcaggttctcctacggctaccttgttacgacttcaccctaatcatctgtcccaccttagacggctagctcctaaaaggttaccccaccggctttgggtgttacaaactctcatggtgtgacgggcggtgtgtacaaggcccgggaacgtattcaccgcggcatgctgatccgcgattactagcgattccgacttcgtgtaggcgagttgcagcctacagtccgaactgagaatggttttaagagattagcttaacctcgcggtctcgcgactcgttgtaccatccattgtagcacgtgtgtagcccaggtcataaggggcatgatgatttgacgtcgtccccaccttcctccggtttgtcaccggcagtctcactagagtgcccaacttaatgctggcaactagtaataagggttgcgctcgttgcgggacttaacccaacatctcacgacacgagctgacgacaaccatgcaccacctgtcattctgtccccgaagggaacctctaatctcttagactgtcagaagatgtcaagacctggtaaggttcttcgcgtagcttcgaattaaaccacatgctccaccgcttgtgcgggcccccgtcaattcttttgagtttcaaccttgcggtcgtactccccaggcggattacttaatgcgttagctgcagcactgaagggcggaaaccctccaacacttagtaatcatcgtttacggcatggactaccagggtatctaatcctgttcgctacccatgctttcgagcctcagcgtcagttgcagaccagacagccgccttcgccactggtgttcttccatatatctacgcatttcaccgctacacatggagttccactgtcctcttctgcactcaagtctcccagtttccaatgcacttcttcggttgagccgaaggctttcacattagacttaaaagaccgcctgcgctcgctttacgcccaataaatccggataacgcttgccacctacgtattaccgcggctgctggcacgtagttagccgtggctttctggttaaataccgtcactgggtaaacagttactcttacccacgttcttctttaacaacagagctttacgagccgaaacccttcttcactcacgcggcgttgctccatcagacttgcgtccattgtggaagattccctactgctgcctcccgtaggagtctgggccgtgtctcagtcccaatgtggccgattaccctctcaggtcggctacgtatcactgccttggtgagcctttacctcaccaactagctaatacgccgcgggtccatccagaagtgatagcagagccatcttttaaaagaaaaccatgcggttttctctgttatacggtattagcatctgtttccaggtgttatcccctacttctgggcaggttacccacgtgttactcacccgttcgccactcacttcgtgttaaaatctcaatcagtacaagtacgtcataatcaattaacggaagttcgttcgacttgcatgtattaggcacgccgccagcgttcatcctgagccaagatcaaactctcatattaaatgatgagtctttttcaagctcattaattgtttgttttgcgaattgacttcgcataatgttttcttacataatcttgcgatttgtaagaccctacactattgattgtcaaaattttgttcagttttcaaaggtctactatcgttgtcatatcaacggaaaatatgttacatattgcaagcgtttacaagaaaattattttcttgtacaattttgatgttataattaaataaatcacaaactcgagataatcacgatggcaaattttaatttaagacttcaagcttatcaagccaattttagcgataaggaaaaagaattagcacaatttttattaaaaaatcaggcccaaactacccaacttacgatatctgaacttagccatagaactaatatctctactgcgactatttcacgttttgccaagaatctaggttttgataattttcaagctttaaaactctgcatagctcaaaatatagaaactaataatccctatgtagaaatcagccctgccgattctcctaaaaccatggctaaaaagatatttaaattgaatgtggatactttaaatgctactgaaaatgctctaaatggaaaagatttagatcagtgtgtaaatttaattttaaatactaaaaaactaggtttatttggcttaggtgctagcaacattgttgcattaaatggatttcataagtttttacgtaccactatcgaacccatctatgcaagtgattttcatatgcaattaatggaagcagcccgcctctcaaaaaatgatgtgatgctgttagtatctcattcgggggaaaatcgggatgccctcgccctagctgaagttgctaaagaacgtaatattccactaatattaattactagttctgctaactcaactctctcaaaaaaagctgatgttactcttgtttcagtcgctgaagaatcactttaccgcccggatgccttacacacactcattgctcaaattagtataatggataccttatttatgataattgctattaagaccaaacgaaatattgctaccaatattcgacacgaaattgataaaactagaaatagacaataaaaatttcaaaatactgttataatgcttttatcaaacaaactggagtgatcactatgcctcaaaagccattaacagaatacacaattgatattccaaaggttgctgaactattagaagataccgatagtttacatactttttttattaaacttactccgggatatcagcgcgaatgggctcgttttatttttggagttaaatctgaagcgactaaaatccgtcacattgaacagatgaaagccgtttttgaagccggatttaaatcaaaacgagcttatgatcaacgaaataaataatttttaacgcctctaaaagggcgttttttatttggaaaactttcgactaatccacgcaactagcattgatacacttgatatagctataaatacaattccttcgccttgattgttttctactattgctaatacctgtccataaaaaacttctcctaaaggtagtgccaccattgaaatcaacattacaatcgccaatacacttcctaacatattaggctcaaccctaccttgaatttcactaagtatagcaatcgaaactacggtaaatacaaattgaactaatacaaaacttaagataatacagctaattatcaataattgactgtttaaatatagcattgctaaacctgttattaacaataaacccgttgataccatcattaatatgaaaggaggatgagagattcgaactctcgcgtggtttgacccacctgacggttttcaagaccgttcccttcagccagacttgggtaatcctccataataaaaatatacgttttactgccctatactaacaaaagctagatggaccttgtaggactcgaacctacgaccgaacggttatgagccgtttgctctaaccaactgagctaaaggtccaagttcgtatattaaccctatcgcggcggaggggatcgaacccccgacctcccgggtatgaaccggacgctctagccagctgagctacaccgcgatctatatattgaaacaataaatgtatttaaacatttaatcgggaagacaggattcgaacctgcgaccccctggtcccaaaccaggtgctctaccaagctgagctacttcccgttaaaacaatgcacccagtaggagtcgaacctacaaccttctgattcgtagtcagacactctatccagttgcgctatgggtgcataataagtgccgaggaccgggatcgaaccggtacggttatcactaaccgcaggattttaagtcctgtgcgtctgccaattccgccaccccggcatctttgctatagtagtaagggattactactaagcggaagacgggattcgaacccgcgacccccaccatggcaaggtgatgttctaccactgaactacttccgcaaaattgatatgccgactagaggattcgaacctccgaccccctgtttacaagacagatgctctgccaactgagctaagtcggcattatcacttattaatgccatatatttacttttatgaaacatagcactaatttgtgctatgagccgtgacaggctcgaactgtcgaccctctgattaaaagtcagatgctctaccaactgagctaacggctcaaaatataatgggggatacagggctcgaacctgtgacctcctgcttgtaaggcagatgctctcccaactgagctaatcccccatttatatatgaccatttcgaagaaaaagttagtttgtctacgttaaccgaggtattggacgtgtcgaaaagttatcttagccgaatttttagacaaacggttggtactagtgtaaaccagtttattctggatatcaaaatgaagcaagcatgttattacttaaaagatactaatttggcagttcatcaaattgcctctcgattgggctacgatgatccatactatttttcaagaatttttaaaaaggtggtaggtagttctccacgggtttttaggaagcaagaaaaaaataggctgtagccaattatccatgtttatgagtttatattccatgtttctgataccgctttcaatacataatatgaatgtattgagggcgtttttttagaatggaagtgataattttgtattaaatgtattatatttacgtctaattttaagtgatatagcaatgatgtataaaaatcctgcgatgaagatttaatatatggaaaaatttcactgtaccattgagtattttttgttgagagaaggaagagtaaatgtagtaaatatataaaatgtttatgtatagaacaagaaatatcggttctatcaaaagagatacattttagtttcactgattcgataagtacttcttaattaaaaatatgattacgaaaaacgtagttaagtaataatttgtttaaagttaattataattggaatacttataatctggacgaggtggaaatgttttgagtaaataaagttaattaataatcaaatgttgatgacccgtacgggattcgaacccatgttactgccgtgaaagggcagtgtcttaaccacttgaccaacgggtcataaatataaaatatacaagctacggagaaggagggattcgaaccctcgcgccgcttgcgcgacctacacccttagcaggggcgcctcttcagccacttgagtacttctccaaatgggcctaaatggactcgaaccatcgacctcacgcttatcaggcgtgcgctctaaaccagctgagctataggcccatataaaaatataacaaaagcgggtgacgagaatcgaactcgcgacaacagcttggaaggctgtggttttaccactaaactacacccgcataataaaggtattaaattgtgaatggcgcgggacagaatcgaactgccgacacatggagcttcaatccattgctctaccgactgagctaccgagccattttataattggctaaatcaggggagaattggtttctctttgaatgatctacctgaacatggcgtacgccaacggcgtaacgttgaccaacgatccaaatataatcaatctttggggcgatcaattgaacagcgtcccatgatgattaatcaacgtaatcgcatcggcgattttgaactagatacagtcgttggtcctcgtgggcatagtaaggcagttttattaactttaatcgatcgaaaatcacggttcctttgggcataccggttaaaagatcggacgacagcgactgttaatgaagcactaactaagttcctaaccacttttaatggtccggtgcacagctttactgtggaccgtggcactgagtttagtgggctagtatcacttgaatcacaatatggtattaagacctattactgccatgcttatacgccagctgaggctgaaccgatcaccgtcaacaatttcttatgaattatctcgatgtcaaccttatcaggctgaattagcacaaacagatgccgaatacaagcgatcacgatgtggtcggaaaactaagctgagcgatgagttaaagcaaaaaattctcaaccatttacgtctaagctggtcaccaggaatgattgctcacgaatttaaactagctactaaatctattgaataaacaaccttagttgtttaatggagaatagcgggatcgaaccgctgacctcctgcgtgcaaggcaggcgctctcccagctgagctaattccccatgtatgggcctaaatggactcgaaccatcgacctcacgcttatcaggcgtgcgctctaaaccagctgagctataggcccgatacgcgtgctctgagagtagttgttagcgcttttgacaacttaattagtatatcgtgtggagattcaaatgtcaacaactaattttaattaatttgaattaaaatttgaaaacttgatgacgtcatctctcgcgacaacagaaatatactatacactcgtttttaaggttcgtcaacacttttgcattatcgcgggatggagcagtctggtagctcgtcgggctcataacccgaaggtcgtaggttcaaatcctgctcccgcaattatggtcctatggtctagctggttaggacgcctgcctgtcacgcaggagatcacgagttcgagtctcgttaggaccgt

(The sequence listing continues in the following parts.)

What is claimed is:

1. A nutritional supplement comprising a bacterial mixture and a carrier, the bacterial mixture comprising:
   (i) a first bacterial strain comprising a genome having at least 99.5% average nucleotide identity (ANI) to the genome of SEQ ID NO: 18, and which reduces abundance of one or more volatile sulfur compounds (VSCs);
   (ii) a second bacterial strain comprising a genome having at least 99.5% ANI to the genome of SEQ ID NO: 19, and which enhances the reduction in abundance of one or more VSCs by the first bacterial strain; and
   (iii) a third bacterial strain comprising a genome having at least 99.5% ANI to the genome of SEQ ID NO: 20, and which reduces pH of an oral microenvironment of a subject to a value less than 7.5, wherein each of the bacterial strains is lyophilized and in powder form, wherein the nutritional supplement has a water content of 5% or less.

2. The nutritional supplement of claim 1, wherein the nutritional supplement comprises a fiber and/or a starch.

3. The nutritional supplement of claim 1, wherein the nutritional supplement comprises maltodextrin.

4. The nutritional supplement of claim 2, wherein the nutritional supplement comprises tapioca and/or a fiber selected from the group consisting of sugar beet pulp, chicory pulp, chicory, coconut endosperm fiber, wheat fiber, fructooligosaccharides, galactooligosaccharides, and inulin.

5. The nutritional supplement of claim 1, wherein the nutritional supplement is in the form of powder meal topper.

6. The nutritional supplement of claim 1, wherein the nutritional supplement comprises a dried algae.

7. The nutritional supplement of claim 6, wherein the nutritional supplement comprises a dried algae selected from the group consisting of *Ascophyllum nodosum, Spirulina, Chlorella, Ulva lactuca, Laminaria digitata* and *Fucus vesiculosus.*

8. The nutritional supplement of claim 1, wherein:
   the first bacterial strain comprises a 16S rDNA sequence with at least 99% sequence identity to the nucleotide sequence of SEQ ID NO: 1;
   the second bacterial strain comprises a 16S rDNA sequence with at least 99% sequence identity to the nucleotide sequence of SEQ ID NO: 2; and the third bacterial strain comprises a 16S rDNA sequence with at least 99% sequence identity to the nucleotide sequence of SEQ ID NO: 3.

9. The nutritional supplement of claim 1, wherein the nutritional supplement comprises an antioxidant selected from the group consisting of vitamin A, vitamin C, vitamin E, green tea polyphenol, tannins, resveratrol, flavonoids, anthrocyanins, indoleacrylic acid, indolepropionic acid, indole-3-carbinol, indoleacrylic acid, indolelactic acid, indoleacetic acid indolepyruvic acid, tryptophol, and Coenzyme Q10.

10. The nutritional supplement of claim 1, wherein the nutritional supplement comprises $1 \times 10^5$ to $1 \times 10^{10}$ colony forming units (CFUs) of each of the bacterial strains.

11. The nutritional supplement of claim 1, wherein the nutritional supplement treats or prevents one or more symptoms of halitosis in a subject.

12. The nutritional supplement of claim 1, wherein the nutritional supplement reduces abundance of one or more VSCs in an oral cavity of a subject.

13. The nutritional supplement of claim 1, wherein the nutritional supplement reduces abundance of one or more microorganisms that produce one or more VSCs in an oral cavity of a subject.

14. The nutritional supplement of claim 1, wherein the nutritional supplement treats or prevents one or more symptoms of oral inflammation in a subject.

15. The nutritional supplement of claim 1, wherein the nutritional supplement reduces abundance of or prevents formation of gingivitis, plaque, tartar, and/or dental calculus in a subject.

16. The nutritional supplement of claim 11, wherein the subject is a dog or cat.

17. The nutritional supplement of claim 1, wherein the nutritional supplement, wherein the nutritional supplement comprises a grain selected from the group consisting of wheat, corn, rice, oats, and barley.

18. The nutritional supplement of claim 1 wherein the nutritional supplement comprises a meat and/or animal-derived material.

* * * * *